US011898142B2

(12) United States Patent
Zhang et al.

(10) Patent No.: US 11,898,142 B2
(45) Date of Patent: Feb. 13, 2024

(54) MULTI-EFFECTOR CRISPR BASED DIAGNOSTIC SYSTEMS

(71) Applicants: THE BROAD INSTITUTE, INC., Cambridge, MA (US); MASSACHUSETTS INSTITUTE OF TECHNOLOGY, Cambridge, MA (US); PRESIDENT AND FELLOWS OF HARVARD COLLEGE, Cambridge, MA (US)

(72) Inventors: Feng Zhang, Cambridge, MA (US); Jonathan Gootenberg, Cambridge, MA (US); Omar Abudayyeh, Cambridge, MA (US)

(73) Assignees: The Broad Institute, Inc., Cambridge, MA (US); Massachusetts Institute of Technology, Cambridge, MA (US); President and Fellows Harvard College, Cambridge, MA (US)

( * ) Notice: Subject to any disclaimer, the term of this patent is extended or adjusted under 35 U.S.C. 154(b) by 763 days.

(21) Appl. No.: 16/645,571

(22) PCT Filed: Sep. 7, 2018

(86) PCT No.: PCT/US2018/050091
§ 371 (c)(1),
(2) Date: Mar. 9, 2020

(87) PCT Pub. No.: WO2019/051318
PCT Pub. Date: Mar. 14, 2019

(65) Prior Publication Data
US 2020/0277600 A1 Sep. 3, 2020

Related U.S. Application Data

(60) Provisional application No. 62/630,808, filed on Feb. 14, 2018, provisional application No. 62/610,121, filed on Dec. 22, 2017, provisional application No. 62/556,408, filed on Sep. 9, 2017.

(51) Int. Cl.
| C12N 15/113 | (2010.01) |
| C12N 9/22 | (2006.01) |
| G01N 33/53 | (2006.01) |
| B01L 3/00 | (2006.01) |

(52) U.S. Cl.
CPC .......... *C12N 15/113* (2013.01); *B01L 3/5085* (2013.01); *C12N 9/22* (2013.01); *G01N 33/5308* (2013.01); *B01L 2300/123* (2013.01); *B01L 2300/126* (2013.01); *C12N 2310/20* (2017.05); *C12N 2800/80* (2013.01)

(58) Field of Classification Search
None
See application file for complete search history.

(56) References Cited

U.S. PATENT DOCUMENTS

| 10,266,886 | B2 * | 4/2019 | Abudayyeh .......... C12Q 1/6816 |
| 2011/0111517 | A1 | 5/2011 | Siegel et al. |
| 2012/0238008 | A1 | 9/2012 | Henry et al. |
| 2015/0211058 | A1 | 7/2015 | Carstens |
| 2016/0153005 | A1 | 6/2016 | Zhang et al. |
| 2017/0198286 | A1 | 7/2017 | Siksnys et al. |
| 2017/0211142 | A1 | 7/2017 | Smargon et al. |
| 2019/0144929 | A1 | 5/2019 | Abudayyeh et al. |

FOREIGN PATENT DOCUMENTS

| WO | 2013/071301 A1 | 5/2013 |
| WO | 2016/035044 A1 | 3/2016 |
| WO | 2016/123243 A1 | 8/2016 |
| WO | 2017070605 A1 | 4/2017 |
| WO | 2018107129 A1 | 6/2018 |
| WO | 2018107129 A8 | 7/2019 |

OTHER PUBLICATIONS

Office Action from corresponding Russian application No. 2020113072 dated Feb. 21, 2022, all enclosed pages cited.
Smirnov A.V. et al., CRISPR/Cas9 system—a universal tool for genomic engineering, Vavilov Journal of Genetics and Breeding, 2016; 20(4), all enclosed pages cited.
Office Action of corresponding Russian application No. 2020113072 dated Jun. 21, 2022, all enclosed pages cited.
Search Report of corresponding Russian application No. 2020113072 dated Jun. 21, 2022, all enclosed pages cited.
Office Action from corresponding Saudi Arabian application No. 520411500 dated Dec. 15, 2021, all enclosed pages cited.
Formalities report from corresponding Russian application No. 2020113072 dated Apr. 30, 2020, all enclosed pages cited.
Li, et al., "CRISPR-Cas12a-assisted nucleic acid detection," Cell Discovery, vol. 4, No. 1, Apr. 24, 2018, all enclosed pages cited.
Myhrvold, et al., "Field deployable viral diagnostics using CRISPR-Cas13," Science, vol. 360, No. 6387, Apr. 27, 2018, all enclosed pages cited.

(Continued)

*Primary Examiner* — Brent T Page
(74) *Attorney, Agent, or Firm* — F. Brent Nix, Esq.; Johnson, Marcou, Isaacs & Nix, LLC

(57) ABSTRACT

The embodiments disclosed herein utilized RNA targeting effectors to provide a robust CRISPR-based diagnostic with attomolar sensitivity. Embodiments disclosed herein can detect both DNA and RNA with comparable levels of sensitivity and can differentiate targets from non-targets based on single base pair differences. Moreover, the embodiments disclosed herein can be prepared in freeze-dried format for convenient distribution and point-of-care (POC) applications. Such embodiments are useful in multiple scenarios in human health including, for example, viral detection, bacterial strain typing, sensitive genotyping, and detection of disease-associated cell free DNA.

53 Claims, 53 Drawing Sheets
Specification includes a Sequence Listing.

(56) References Cited

OTHER PUBLICATIONS

Gootenberg, et al., "Multiplexed and portable nucleic acid detection platform with Cas13, Cas12a, and Csm6—Supplementary Materials," Science, vol. 360, No. 6387, Apr. 27, 2018, all enclosed pages cited.
Pickar-Oliver, et al., "The next generation of CRISPR-Cas technologies and applications," Nat Rev Mol Cell Biol, vol. 20, No. 8, May 30, 2019, all enclosed pages cited.
Li, et al., "CRISPR/Cas systems towards next-generation biosensing," Trends in Biotechnology, vol. 37, No. 7, Jul. 14, 2019, all enclosed pages cited.
Extended Search Report and Written Opinion of corresponding European application No. 18853355.8 dated Jun. 2, 2021, all enclosed pages cited.
"International Search Report and Written Opinion issued in International Application No. PCT/US2018/050091", dated Jan. 16, 2019, 19 pages.
"Invitation to Pay Additional Fees issued in International Application No. PCT/US2018/050091", dated Nov. 21, 2018, 3 pages.
Abudayyeh, et al., "C2C2 is a Single-Component Programmable RNA-Guided RNA-Targeting CRISPR Effector", Science, vol. 353, No. 6299, Aug. 5, 2016, 23 pages.
Anantharaman, et al., "Comprehensive Analysis of the HEPN Superfamily: Identification of Novel Roles in Intra-Genomic Conflicts, Defense, Pathogenesis and RNA Processing", Biology Direct, vol. 8, No. 15, Jun. 15, 2013, 28 pages.
Du, et al., "Coupling Sensitive Nucleic Acid Amplification with Commercial Pregnancy Test Strips", Angewandte Chemie International Edition in Englis, vol. 56, No. 4, Jan. 19, 2017, 12 pages.
Gootenberg, et al., "Nucleic Acid Detection with CRISPR-Cas13a/C2c2", Science, vol. 356, No. 6336, Apr. 13, 2017, 438-442.
Green, et al., "Toehold Switches: De-Novo-Designed Regulators of Gene Expression", Cell, vol. 159, No. 4, Nov. 6, 2014, 28 pages.
Kazlauskiene, et al., "A Cyclic Oligonucleotide Signaling Pathway in type III CRISPR-Cas Systems", Science, vol. 357, No. 6351, Aug. 11, 2017, 6 pages.
Kim, "Crystal structure and nucleic acid-binding activity of the CRISPR-associated protein Csx1 of Pyrococcus furiosus", Proteins, vol. 81, No. 2, Feb. 2013, 261-270.
Kumar, et al., "The Use of RNA Sequencing to Identify Disease-Specific Gene Expression Signatures and Critical Regulatory Networks Across Hematologic Malignancies," Blood, 2014, 124 (21): 2203, all enclosed pages cited.
Makarova, et al., "CARF and WYL Domains: Ligand-Binding Regulators of Prokaryotic Defense Systems", Frontiers in Genetics, vol. 5, Article 102, Apr. 2014, 09 pages.
Marraffini, et al., "CRISPR Interference Limits Horizontal Gene Transfer in Staphylococci by Targeting DNA", Science, vol. 322, No. 5909, Dec. 19, 2008, 7 pages.
Millen, et al., "Mobile CRISPR/Cas-Mediated Bacteriophage Resistance in Lactococcus lactis", Public Library of Science ONE, vol. 7, No. 1, Dec. 2012, 9 pages.
Niewoehner, et al., "Structural Basis for the Endoribonuclease Activity of the Type III-A CRISPR-Associated Protein Csm6", Cold Spring Harbor Laboratory Press, vol. 22, No. 3, 2016, 318-329.
Niewoehner, et al., "Type III CRISPR-Cas Systems produce Cyclic Oligoadenylate Second Messengers", Nature, vol. 548, No. 6449, Aug. 31, 2017, 543-548.
Pardee, et al., "Paper-Based Synthetic Gene Networks", Cell, vol. 159, No. 4, Nov. 6, 2014, 28 pages.
Pardee, et al., "Rapid, Low-Cost Detection of Zika Virus Using Programmable Biomolecular Components", Cell, vol. 165, No. 5, May 19, 2016, 1255-1266.
Rouillon, et al., "Structure of the CRISPR Interference Complex CSM Reveals Key Similarities with Cascade", Molecular Cell, vol. 52, No. 1, Oct. 10, 2013, 124-134.
Shafiee, et al., "Paper and Flexible Substrates as Materials for Biosensing Platforms to Detect Multiple Biotargets", Scientific Reports, vol. 5, No. 8719, Mar. 6, 2015, 1-9.
Urdea, et al., "Requirements for High Impact Diagnostics in the Developing World", Nature, vol. 444, 2006, 73-79.
Wang, et al., "Flexible Substrate-Based Devices for Point-of-Care Diagnostics", Trends in Biotechnology, vol. 34, No. 11, Nov. 2016, 909-921.
Zhao, et al., "Signal Amplification of Glucosamine-6-Phosphate Based on Ribozyme GlmS", Biosensors and Bioelectronics, vol. 62, Dec. 15, 2014, 337-342.
Office Action of corresponding European application No. 18853355.8 dated Dec. 22, 2022, all enclosed pages cited.
Office Action of corresponding Israeli application No. 273191 dated Jul. 31, 2023, all enclosed pages cited.
East-Seletsky, et al., "Two distinct RNase activities of CRISPR-C2c2 enable guide-RNA processing and RNA detection," Nature, vol. 538, Oct. 13, 2016, all enclosed pages cited.
Office Action from corresponding Chinese application No. 201880072772.2 dated Jul. 7, 2023, all enclosed pages cited.
Search Report from corresponding Chinese application No. 201880072772.2 dated Jul. 7, 2023, all enclosed pages cited.
Smargon, et al., "Cas13b is a type VI-B CRISPR-associated RNA-guided RNAse differentially regulated by accessory proteins Csx27 and Csx28," Mol Cell, 65(4), Feb. 2017, all enclosed pages cited.

* cited by examiner

A

B

A activator designs

Design 1  AAAAAAUUUUU-OH
Design 2  UUUUUAAAAAA>P
Design 3  AAAAAAUUUUUAAAAAA>P
Design 4  AAAAAA>P

| Name | Sequence | 1st Fig. |
|---|---|---|
| poly A (n=5) 2',3' cyclic phosphate end | rArArArArA-(2,3-cyclic phosphate) | Fig. 4 |
| poly A (n=6) 2',3' cyclic phosphate end | rArArArArArA-(2,3-cyclic phosphate) | Fig. 4 |
| poly A (n=7) 2',3' cyclic phosphate end | rArArArArArArA-(2,3-cyclic phosphate) | Fig. 4 |
| poly A (n=8) 2',3' cyclic phosphate end | rArArArArArArArA-(2,3-cyclic phosphate) | Fig. 4 |
| Csm6 polyA polyU probes for U cutters 4 As | rArArArArUrUrUrUrU | Fig. 4 |
| Csm6 polyA polyU probes for U cutters 5 As | rArArArArArUrUrUrUrU | Fig. 4 |
| Csm6 polyA polyU probes for U cutters 6 As | rArArArArArArUrUrUrUrU | Fig. 4 |
| Csm6 polyA polyU probes for U cutters 7 As | rArArArArArArArUrUrUrUrU | Fig. 4 |
| 5' poly U / polyA 6A probe 2,3 cyclic phosphate | rUrUrUrUrUrArArArArArA-(2,3-cyclic phosphate) | fig. S31 |
| 5'poly A/ poly U / polyA 6A probe 2,3 cyclic phosphate | rArArArArArArUrUrUrUrUrArArArArArA-(2,3-cyclic phosphate) | fig. S31 |

FIGURE 38

| Abbreviation | Protein name | Strain name | Benchling link | Accession number |
|---|---|---|---|---|
| Lwa | LwaCas13a | Leptotrichia wadei | https://benchling.com/s/seq-66CfLwu7sLMQMbcXe7lh | WP_021746774.1 |
| Lba | LbaCas13a | Lachnospiraceae bacterium NK4A179 | https://benchling.com/s/seq-xdOysFqbmqAsTRoTiERc | WP_022785443.1 |
| Lbu | LbuCas13a | Leptotrichia buccalis C-1013-b | https://benchling.com/s/seq-e0aUn6uEVvWXntoggf60 | WP_015770004.1 |
| Bzo | BzoCas13b | Bergeyella zoohelcum | https://benchling.com/s/seq-mA3sJ4Gll4x0JB5q7KHK | WP_002664492 |
| Pin | PinCas13b | Prevotella intermedia | https://benchling.com/s/seq-iA58bdz9mHOZmbFLj92f | WP_036860899 |
| Pbu | PbuCas13b | Prevotella buccae | https://benchling.com/s/seq-nNv4KSqZDFtdPX88zSS2 | WP_004343973 |
| Asp | AspCas13b | Alistipes sp. ZOR0009 | https://benchling.com/s/seq-iHs6D7J5Z2NkCbbkqqek | WP_047447901 |
| Psm | PsmCas13b | Prevotella sp. MA2016 | https://benchling.com/s/seq-v7Q1TzaZzAyNZIGKNnH3 | WP_036929175 |
| Ran | RanCas13b | Riemerella anatipestifer | https://benchling.com/s/seq-HIhclUZszBOQAdW5rimW | WP_004919755 |
| Pau | PauCas13b | Prevotella aurantiaca | https://benchling.com/s/seq-Se9MuspJQek3x4vvR1BF | WP_025000926 |
| Psa | PsaCas13b | Prevotella saccharolytica | https://benchling.com/s/seq-NXtrOPLbhpvc9nZk1seq | WP_051522484 |
| Pin2 | Pin2Cas13b | Prevotella intermedia | https://benchling.com/s/seq-mSXhS57arjPDuvnQjZOn | WP_061868553 |
| Cca | CcaCas13b | Capnocytophaga canimorsus | https://benchling.com/s/seq-BNVzFUQjgSnkYLARxLwE | WP_013997271 |
| Pgu | PguCas13b | Porphyromonas gulae | https://benchling.com/s/seq-GVOv8zBVlta2ulHyuTSR | WP_039434803 |
| Psp | PspCas13b | Prevotella sp. P5-125 | https://benchling.com/s/seq-XmnWQgXrpyVAwXoNtJGw | WP_044065294 |
| Pig | PigCas13b | Porphyromonas gingivalis | https://benchling.com/s/seq-hxdDNJtJmA5axRvcxm0p | WP_053444417 |
| Pin3 | Pin3Cas13b | Prevotella intermedia | https://benchling.com/s/seq-GlaCfl5cDw4sKXz6LM11 | WP_050955369 |
| Ei | EiCsm6 | Enterococcus italicus | https://benchling.com/s/seq-YrP8xiVG3rBwxYMqCUH0 | WP_007208953.1 |
| Ls | LsCsm6 | Lactobacillus salivarius | https://benchling.com/s/seq-duuAaForfhsBc53zLY5z | WP_081509150.1 |
| Tt | TtCsm6 | Thermus thermophilus | https://benchling.com/s/seq-esibVH1mHPjHYXxKWia | WP_011229148.1 |

FIG. 39

| Name | Ortholog | Complete crRNA sequence | Spacer | Direct repeat | Target | 1st Fig. |
|---|---|---|---|---|---|---|
| ssRNA/ssDNA 1 crRNA 2 | LwaCas13a | GATTTAGACTACCCCAAAA ACGAAGGGGACTAAAACCT ACCAAGTAATCCATATTTC TAGAGGATC | CTACCAAG TAATCCAT ATTTCTAG AGGATC | GATTTAGACTAC CCCAAAAACGAA GGGGACTAAAAC | ssRNA 1 | Fig. 1B/fig. S3 |
| BzoCas13b ssRNA/ssDNA crRNA 2 | BzoCas13b | CTACCAAGTAATCCATATT TCTAGAGGATCGTTGGAAC TGCTCTCATTTTGGAGGGT AATCACAAC | CTACCAAG TAATCCAT ATTTCTAG AGGATC | GTTGGAACTGCT CTCATTTTGGAG GGTAATCACAAC | ssRNA 1 | Fig. 1B/fig. S3 |
| PinCas13b ssRNA/ssDNA crRNA 2 | PinCas13b | CTACCAAGTAATCCATATT TCTAGAGGATCGTTGCATC TGCCTGCTGTTTGCAAGGT AAAAACAAC | CTACCAAG TAATCCAT ATTTCTAG AGGATC | GTTGCATCTGCC TGCTGTTTGCAA GGTAAAAACAAC | ssRNA 1 | Fig. 1B/fig. S3 |
| PbuCas13b ssRNA/ssDNA crRNA 2 | PbuCas13b | CTACCAAGTAATCCATATT TCTAGAGGATCGTTGCATC TGCCTTCTTTTTGAAGGT AAAAACAAC | CTACCAAG TAATCCAT ATTTCTAG AGGATC | GTTGCATCTGCC TTCTTTTTGAAA GGTAAAAACAAC | ssRNA 1 | Fig. 1B/fig. S3 |
| AspCas13b ssRNA/ssDNA crRNA 2 | AspCas13b | CTACCAAGTAATCCATATT TCTAGAGGATCGCTGTTAT ATCCTTACCTTTGTAAGGG AAGTACAGC | CTACCAAG TAATCCAT ATTTCTAG AGGATC | GCTGTTATATCC TTACCTTTGTAA GGGAAGTACAGC | ssRNA 1 | Fig. 1B/fig. S3 |
| PsmCas13b ssRNA/ssDNA crRNA 2 | PsmCas13b | CTACCAAGTAATCCATATT TCTAGAGGATCGTTGTAGA AGCTTATCGTTTGGATAGG TATGACAAC | CTACCAAG TAATCCAT ATTTCTAG AGGATC | GTTGTAGAAGCT TATCGTTTGGAT AGGTATGACAAC | ssRNA 1 | Fig. 1B/fig. S3 |
| RanCas13b ssRNA/ssDNA crRNA 2 | RanCas13b | CTACCAAGTAATCCATATT TCTAGAGGATCGTTGGGAC TGCTCTCACTTTGAAGGT ATTCACAAC | CTACCAAG TAATCCAT ATTTCTAG AGGATC | GTTGGGACTGCT CTCACTTTGAAG GGTATTCACAAC | ssRNA 1 | Fig. 1B/fig. S3 |
| PauCas13b ssRNA/ssDNA crRNA 2 | PauCas13b | CTACCAAGTAATCCATATT TCTAGAGGATCGTTGTATC TGCCTTCTGTTTGAAGGT AAAAACAAC | CTACCAAG TAATCCAT ATTTCTAG AGGATC | GTTGTATCTGCC TTCTGTTTGAAA GGTAAAAACAAC | ssRNA 1 | Fig. 1B/fig. S3 |
| PsaCas13b ssRNA/ssDNA crRNA 2 | PsaCas13b | CTACCAAGTAATCCATATT TCTAGAGGATCGTTGTGTC TACCTCCTTTTTGAGAGGT AAAAACAGC | CTACCAAG TAATCCAT ATTTCTAG AGGATC | GTTGTGTCTACC TCCTTTTTGAGA GGTAAAAACAGC | ssRNA 1 | Fig. 1B/fig. S3 |
| Pin2Cas13b ssRNA/ssDNA crRNA 2 | Pin2Cas13b | CTACCAAGTAATCCATATT TCTAGAGGATCGTTGCATC TGCCTGCTGTTTGCAAGGT AAAAACAAC | CTACCAAG TAATCCAT ATTTCTAG AGGATC | GTTGCATCTGCC TGCTGTTTGCAA GGTAAAAACAAC | ssRNA 1 | Fig. 1B/fig. S3 |
| CcaCas13b ssRNA/ssDNA crRNA 2 | CcaCas13b | CTACCAAGTAATCCATATT TCTAGAGGATCGTTGGAAC TGCTCTCATTTTGGAGGGT AATCACAAC | CTACCAAG TAATCCAT ATTTCTAG AGGATC | GTTGGAACTGCT CTCATTTTGGAG GGTAATCACAAC | ssRNA 1 | Fig. 1B/fig. S3 |
| PguCas13b ssRNA/ssDNA crRNA 2 | PguCas13b | CTACCAAGTAATCCATATT TCTAGAGGATCGTTGGATC TACCTCTATTTGAAGGT ACACACAAC | CTACCAAG TAATCCAT ATTTCTAG AGGATC | GTTGGATCTACC CTCTATTTGAAG GGTACACACAAC | ssRNA 1 | Fig. 1B/fig. S3 |
| PspCas13b ssRNA/ssDNA crRNA 2 | PspCas13b | CTACCAAGTAATCCATATT TCTAGAGGATCGTTGTGGA AGGTCCAGTTTTGAGGGGC TATTACAAC | CTACCAAG TAATCCAT ATTTCTAG AGGATC | GTTGTGGAAGGT CCAGTTTTGAGG GGCTATTACAAC | ssRNA 1 | Fig. 1B/fig. S3 |
| PigCas13b ssRNA/ssDNA crRNA 2 | PigCas13b | CTACCAAGTAATCCATATT TCTAGAGGATCGTTGGATC TACCTCTATTCGAAGGGT ACACACAAC | CTACCAAG TAATCCAT ATTTCTAG AGGATC | GTTGGATCTACC CTCTATTCGAAG GGTACACACAAC | ssRNA 1 | Fig. 1B/fig. S3 |
| Pin3Cas13b ssRNA/ssDNA crRNA 2 | Pin3Cas13b | CTACCAAGTAATCCATATT TCTAGAGGATCGTTGCATC TGCCTGCTGTTTGCAAGGT AAAAACAAC | CTACCAAG TAATCCAT ATTTCTAG AGGATC | GTTGCATCTGCC TGCTGTTTGCAA GGTAAAAACAAC | ssRNA 1 | Fig. 1B/fig. S3 |
| DENV crRNA LwaCas13a | LwaCas13a | GATTTAGACTACCCCAAAA ACGAAGGGGACTAAAACTG CTTGTCTCCAGTGAGCATG GTCTTCG | TGCTTGTG TCCAGTGA GCATGGTC TTCG | GATTTAGACTAC CCCAAAAACGAA GGGGACTAAAAC | DENV ssRNA | Fig. 1D |
| DENV crRNA PsmCas13b | PsmCas13b | TTTGCTTCTGTCCAGTGAG CATGGTCTTCGGTTGTAGA AGCTTATCGTTTGGATAGG TATGACAAC | TTTGCTTC TGTCCAGT GAGCATGG TCTTCG | GTTGTAGAAGCT TATCGTTTGGAT AGGTATGACAAC | DENV ssRNA | Fig. 1D |

FIG. 40

| Name | Enzyme | Spacer | Forward primer | Reverse primer | Target | Figure |
|---|---|---|---|---|---|---|
| ssDNA 1 crRNA Cas12a | AsCas12a | TAATTTCTACTCTTGTAGA TCTGTGTTTATCCGCTCAC AA | CTGTGTTT ATCCGCTC ACAA | TAATTTCTACTC TTGTAGAT | ssDNA 1 | Fig. 1D |
| Thermonuclease crRNA PsmCas13b | PsmCas13b | ATGCTTTGTTTCAGGTGTA TCAACCAATAAGTTGTAGA AGCTTATCGTTTGGATAGG TATGACAAC | ATGCTTTG TTTCAGGT GTATCAAC CAATAA | GTTGTAGAAGCT TATCGTTTGGAT AGGTATGACAAC | Thermon uclease ssDNA | Fig. 1H |
| Acyltransferase LwaCas13a crRNA | LwaCas13a | GATTTAGACTACCCCAAAA ACGAAGGGGACTAAAACAG CACGCTCACCCGCGGGTTG CCTTCG | AGCACGCT CACCCGCG GGTTGCCT TCG | GATTTAGACTAC CCCAAAAACGAA GGGGACTAAAAC | Acyltrans ferase ssDNA | Fig. 1H |
| ZIKV LwaCas13a crRNA | LwaCas13a | GATTTAGACTACCCCAAAA ACGAAGGGGACTAAAACAC TCCCTAGAACCACGACAGT TTGCCTT | ACTCCCTA GAACCACG ACAGTTTG CCTT | GATTTAGACTAC CCCAAAAACGAA GGGGACTAAAAC | ZIKV ssRNA | Fig. 3B |
| EGFR L858R wild-type sensing crRNA | LwaCas13a | GATTTAGACTACCCCAAAA ACGAAGGGGACTAAAACCC AGGCCAAAATCTGTGATCT TGACATG | CCAGGCCA AAATCTGT GATCTTGA CATG | GATTTAGACTAC CCCAAAAACGAA GGGGACTAAAAC | EGFR L858L WT | Fig. 3E |
| EGFR L858R mutant sensing crRNA | LwaCas13a | GATTTAGACTACCCCAAAA ACGAAGGGGACTAAAACCC CGGCCAAAATCTGTGATCT TGACATG | CCCGGCCA AAATCTGT GATCTTGA CATG | GATTTAGACTAC CCCAAAAACGAA GGGGACTAAAAC | EGFR L858R mutation | Fig. 3E |
| Exon 19 deletion mutant sensing crRNA | LwaCas13a | GATTTAGACTACCCCAAAA ACGAAGGGGACTAAAACGT TGGCTTTCGGAGATGTCTT GATAGCG | GTTGGCTT TCGGAGAT GTCTTGAT AGCG | GATTTAGACTAC CCCAAAAACGAA GGGGACTAAAAC | EGFR Exon 19 deletion | Fig. 3H |
| Exon 19 deletion wild-type sensing crRNA | LwaCas13a | GATTTAGACTACCCCAAAA ACGAAGGGGACTAAAACGA TGTTGCTTCTTCTTAATTCC TTGATAG | GATGTTGC TTCTTCTTA ATTCCTTG ATAG | GATTTAGACTAC CCCAAAAACGAA GGGGACTAAAAC | EGFR Exon 19 WT | Fig. 3H |
| A-allele (disease) sensing crRNA APC gene (NM_000038.5) crRNA | LwaCas13a | GATTTAGACTACCCCAAAA ACGAAGGGGACTAAAACCC TATCAGGTTTCACAGTAAG CGCGTAT | CCTATCAG GTTTCACA GTAAGCGC GTAT | GATTTAGACTAC CCCAAAAACGAA GGGGACTAAAAC | APC synthetic mutation | Fig. 5D |
| G-allele (healthy) sensing crRNA APC gene (NM_000038.5) crRNA | PsmCas13b | CCTGGTTCATGAGCTTCCT GCCACTGCCAAGTTGTAGA AGCTTATCGTTTGGATAGG TATGACAAC | CCTGGTTC ATGAGCTT CCTGCCAA | GTTGTAGAAGCT TATCGTTTGGAT AGGTATGACAAC | APC synthetic WT | Fig. 5D |
| DENV crRNA LbaCas13a | LbaCas13a | GTTGATGAGAAGAGCCCAA GATAGAGGGCAATAACTGC TTCTGTCCAGTGAGCATGG TCTTCG | TGCTTCTG TCCAGTGA GCATGGTC TTCG | GTTGATGAGAAG AGCCCAAGTAG AGGGCAATAAC | DENV ssRNA | fig. S6A |
| ZIKV crRNA PsmCas13b | PsmCas13b | TGACTCCCTAGAACCACGA CAGTTTGCCTTCTTGTAGA AGCTTATCGTTTGGATAGG TATGACAAC | TGACTCCC TAGAACCA CGACAGTT TGCCTT | GTTGTAGAAGCT TATCGTTTGGAT AGGTATGACAAC | ZIKV ssRNA | fig. S6B |
| ZIKV crRNA LbaCas13a | LbaCas13a | GTTGATGAGAAGAGCCCAA GATAGAGGGCAATAACACT CCCTAGAACCACGACAGTT TGCCTT | ACTCCCTA GAACCACG ACAGTTTG CCTT | GTTGATGAGAAG AGCCCAAGTAG AGGGCAATAAC | ZIKV ssRNA | fig. S6B |
| DENV LbuCas13a 28nt spacer | LbuCas13a | GACCACCCCAAAAATGAAG GGGACTAAAACACTTCTTCT GTCCAGTGAGCATGGTCTT CG | TGCTTCTG TCCAGTGA GCATGGTC TTCG | GACCACCCCAAA AATGAAGGGGAC TAAAACA | DENV ssRNA | fig. S7A |
| ZIKV LbuCas13a | LbuCas13a | GACCACCCCAAAAATGAAG GGGACTAAAACAACTCCCT AGAACCACGACAGTTTGCC TT | ACTCCCTA GAACCACG ACAGTTTG CCTT | GACCACCCCAAA AATGAAGGGGAC TAAAACA | ZIKV ssRNA | fig. S7A |
| DENV LbuCas13a 26nt spacer | LbuCas13a | GACCACCCCAAAAATGAAG GGGACTAAAACATGCTTCT GTCCAGTGAGCATGGTCTT | TGCTTCTG TCCAGTGA GCATGGTC TT | GACCACCCCAAA AATGAAGGGGAC TAAAACA | DENV ssRNA | fig. S7C |
| DENV LbuCas13a 24nt spacer | LbuCas13a | GACCACCCCAAAAATGAAG GGGACTAAAACATGCTTCT GTCCAGTGAGCATGGTC | TGCTTCTG TCCAGTGA GCATGGTC | GACCACCCCAAA AATGAAGGGGAC TAAAACA | DENV ssRNA | fig. S7C |

FIG. 40 cont.

| | | | | | | |
|---|---|---|---|---|---|---|
| DENV LbuCas13a 22nt spacer | LbuCas13a | GACCACCCCAAAAATGAAG GGGACTAAAACATGCTTCT GTCCAGTGAGCATGG | TGCTTCTG TCCAGTGA GCATGG | GACCACCCCAAA AATGAAGGGGAC TAAAACA | DENV ssRNA | fig. S7C |
| DENV LbuCas13a 20nt spacer | LbuCas13a | GACCACCCCAAAAATGAAG GGGACTAAAACATGCTTCT GTCCAGTGAGCAT | TGCTTCTG TCCAGTGA GCAT | GACCACCCCAAA AATGAAGGGGAC TAAAACA | DENV ssRNA | fig. S7C |
| DENV LbuCas13a 18nt spacer | LbuCas13a | GACCACCCCAAAAATGAAG GGGACTAAAACATGCTTCT GTCCAGTGAGC | TGCTTCTG TCCAGTGA GC | GACCACCCCAAA AATGAAGGGGAC TAAAACA | DENV ssRNA | fig. S7C |
| CcaCas13b spacer test 34 nt | CcaCas13b | TGTTCTACCAAGTAATCCA TATTTCTAGAGGATCGTTG GAACTGCTCTCATTTTGGAG GGTAATCACAAC | TGTTCTAC CAAGTAAT CCATATTT CTAGAGGA TC | GTTGGAACTGCT CTCATTTTGGAG GGTAATCACAAC | ssRNA 1 | fig. S10A |
| CcaCas13b spacer test 33 nt | CcaCas13b | GTTCTACCAAGTAATCCAT ATTTCTAGAGGATCGTTGG AACTGCTCTCATTTTGGAG GGTAATCACAAC | GTTCTACC AAGTAATC CATATTTC TAGAGGAT C | GTTGGAACTGCT CTCATTTTGGAG GGTAATCACAAC | ssRNA 1 | fig. S10A |
| CcaCas13b spacer test 32 nt | CcaCas13b | TTCTACCAAGTAATCCATA TTTCTAGAGGATCGTTGGA ACTGCTCTCATTTTGGAGG GTAATCACAAC | TTCTACCA AGTAATCC ATATTTCT AGAGGATC | GTTGGAACTGCT CTCATTTTGGAG GGTAATCACAAC | ssRNA 1 | fig. S10A |
| CcaCas13b spacer test 31 nt | CcaCas13b | TCTACCAAGTAATCCATAT TTCTAGAGGATCGTTGGAA CTGCTCTCATTTTGGAGGG TAATCACAAC | TCTACCAA GTAATCCA TATTTCTA GAGGATC | GTTGGAACTGCT CTCATTTTGGAG GGTAATCACAAC | ssRNA 1 | fig. S10A |
| CcaCas13b spacer test 30 nt | CcaCas13b | CTACCAAGTAATCCATATT TCTAGAGGATCGTTGGAAC TGCTCTCATTTTGGAGGGT AATCACAAC | CTACCAAG TAATCCA ATTTCTA AGGATC | GTTGGAACTGCT CTCATTTTGGAG GGTAATCACAAC | ssRNA 1 | fig. S10A |
| CcaCas13b spacer test 29 nt | CcaCas13b | TACCAAGTAATCCATATTT CTAGAGGATCGTTGGAACT GCTCTCATTTTGGAGGGTA ATCACAAC | TACCAAGT AATCCATA TTTCTAGA GGATC | GTTGGAACTGCT CTCATTTTGGAG GGTAATCACAAC | ssRNA 1 | fig. S10A |
| CcaCas13b spacer test 28 nt | CcaCas13b | ACCAAGTAATCCATATTTC TAGAGGATCGTTGGAACTG CTCTCATTTTGGAGGGTAA TCACAAC | ACCAAGTA ATCCATAT TTCTAGAG GATC | GTTGGAACTGCT CTCATTTTGGAG GGTAATCACAAC | ssRNA 1 | fig. S10A |
| CcaCas13b spacer test 27 nt | CcaCas13b | CCAAGTAATCCATATTTCT AGAGGATCGTTGGAACTGC TCTCATTTTGGAGGGTAAT CACAAC | CCAAGTAA TCTAGAGG ATC | GTTGGAACTGCT CTCATTTTGGAG GGTAATCACAAC | ssRNA 1 | fig. S10A |
| CcaCas13b spacer test 26 nt | CcaCas13b | CAAGTAATCCATATTTCTA GAGGATCGTTGGAACTGCT CTCATTTTGGAGGGTAATC ACAAC | CAAGTAAT CCATATTT CTAGAGGA TC | GTTGGAACTGCT CTCATTTTGGAG GGTAATCACAAC | ssRNA 1 | fig. S10A |
| CcaCas13b spacer test 25 nt | CcaCas13b | AAGTAATCCATATTTCTAG AGGATCGTTGGAACTGCTC TCATTTTGGAGGGTAATCA CAAC | AAGTAATC CATATTTC TAGAGGAT C | GTTGGAACTGCT CTCATTTTGGAG GGTAATCACAAC | ssRNA 1 | fig. S10A |
| CcaCas13b spacer test 24 nt | CcaCas13b | AGTAATCCATATTTCTAGA GGATCGTTGGAACTGCTCT CATTTTGGAGGGTAATCAC AAC | AGTAATCC ATATTTCT AGAGGATC | GTTGGAACTGCT CTCATTTTGGAG GGTAATCACAAC | ssRNA 1 | fig. S10A |
| CcaCas13b spacer test 23 nt | CcaCas13b | GTAATCCATATTTCTAGAG GATCGTTGGAACTGCTCTC ATTTTGGAGGGTAATCACA AC | GTAATCCA TATTTCTA GAGGATC | GTTGGAACTGCT CTCATTTTGGAG GGTAATCACAAC | ssRNA 1 | fig. S10A |
| CcaCas13b spacer test 22 nt | CcaCas13b | TAATCCATATTTCTAGAGG ATCGTTGGAACTGCTCTCA TTTTGGAGGGTAATCACAA C | TAATCCAT ATTTCTAG AGGATC | GTTGGAACTGCT CTCATTTTGGAG GGTAATCACAAC | ssRNA 1 | fig. S10A |
| CcaCas13b spacer test 21 nt | CcaCas13b | AATCCATATTTCTAGAGGA TCGTTGGAACTGCTCTCAT TTTGGAGGGTAATCACAAC | AATCCATA TTTCTAGA GGATC | GTTGGAACTGCT CTCATTTTGGAG GGTAATCACAAC | ssRNA 1 | fig. S10A |
| CcaCas13b spacer test 20 nt | CcaCas13b | ATCCATATTTCTAGAGGAT CGTTGGAACTGCTCTCATT TTGGAGGGTAATCACAAC | ATCCATAT TTCTAGAG GATC | GTTGGAACTGCT CTCATTTTGGAG GGTAATCACAAC | ssRNA 1 | fig. S10A |
| CcaCas13b spacer test 19 nt | CcaCas13b | TCCATATTTCTAGAGGATC GTTGGAACTGCTCTCATTT TGGAGGGTAATCACAAC | TCCATATT TCTAGAGG ATC | GTTGGAACTGCT CTCATTTTGGAG GGTAATCACAAC | ssRNA 1 | fig. S10A |
| CcaCas13b spacer test 18 nt | CcaCas13b | CCATATTTCTAGAGGATCG TTGGAACTGCTCTCATTTT GGAGGGTAATCACAAC | CCATATTT CTAGAGGA TC | GTTGGAACTGCT CTCATTTTGGAG GGTAATCACAAC | ssRNA 1 | fig. S10A |
| CcaCas13b spacer test 17 nt | CcaCas13b | CATATTTCTAGAGGATCGT TGGAACTGCTCTCATTTTG GAGGGTAATCACAAC | CATATTTC TAGAGGAT C | GTTGGAACTGCT CTCATTTTGGAG GGTAATCACAAC | ssRNA 1 | fig. S10A |

FIG. 40 cont.

| Name | Cas13 | Spacer sequence | Target sequence | Reverse complement | ssRNA | Figure |
|---|---|---|---|---|---|---|
| CcaCas13b spacer test 16 nt | CcaCas13b | ATATTTCTAGAGGATCGTT GGAACTGCTCTCATTTTGG AGGGTAATCACAAC | ATATTTCT AGAGGATC | GTTGGAACTGCT CTCATTTTGGAG GGTAATCACAAC | ssRNA 1 | fig. S10A |
| CcaCas13b spacer test 15 nt | CcaCas13b | TATTTCTAGAGGATCGTTG GAACTGCTCTCATTTTGGA GGGTAATCACAAC | TATTTCTA GAGGATC | GTTGGAACTGCT CTCATTTTGGAG GGTAATCACAAC | ssRNA 1 | fig. S10A |
| CcaCas13b spacer test 14 nt | CcaCas13b | ATTTCTAGAGGATCGTTGG AACTGCTCTCATTTTGGAG GGTAATCACAAC | ATTTCTAG AGGATC | GTTGGAACTGCT CTCATTTTGGAG GGTAATCACAAC | ssRNA 1 | fig. S10A |
| CcaCas13b spacer test 13 nt | CcaCas13b | TTTCTAGAGGATCGTTGGA ACTGCTCTCATTTTGGAGG GTAATCACAAC | TTTCTAGA GGATC | GTTGGAACTGCT CTCATTTTGGAG GGTAATCACAAC | ssRNA 1 | fig. S10A |
| CcaCas13b spacer test 12 nt | CcaCas13b | TTCTAGAGGATCGTTGGAA CTGCTCTCATTTTGGAGGG TAATCACAAC | TTCTAGAG GATC | GTTGGAACTGCT CTCATTTTGGAG GGTAATCACAAC | ssRNA 1 | fig. S10A |
| PsmCas13b spacer test 34 nt | PsmCas13b | TGTTCTACCAAGTAATCCA TATTTCTAGAGGATCGTTG TAGAAGCTTATCGTTTGGA TAGGTATGACAAC | TGTTCTAC CAAGTAAT CCATATTT CTAGAGGA TC | GTTGTAGAAGCT TATCGTTTGGAT AGGTATGACAAC | ssRNA 1 | fig. S10B |
| PsmCas13b spacer test 33 nt | PsmCas13b | GTTCTACCAAGTAATCCAT ATTTCTAGAGGATCGTTGT AGAAGCTTATCGTTTGGAT AGGTATGACAAC | GTTCTACC AAGTAATC CATATTTC TAGAGGAT C | GTTGTAGAAGCT TATCGTTTGGAT AGGTATGACAAC | ssRNA 1 | fig. S10B |
| PsmCas13b spacer test 32 nt | PsmCas13b | TTCTACCAAGTAATCCATA TTTCTAGAGGATCGTTGTA GAAGCTTATCGTTTGGATA GGTATGACAAC | TTCTACCA AGTAATCC ATATTTCT AGAGGATC | GTTGTAGAAGCT TATCGTTTGGAT AGGTATGACAAC | ssRNA 1 | fig. S10B |
| PsmCas13b spacer test 31 nt | PsmCas13b | TCTACCAAGTAATCCATAT TTCTAGAGGATCGTTGTAG AAGCTTATCGTTTGGATAG GTATGACAAC | TCTACCAA GTAATCCA TATTTCTA GAGGATC | GTTGTAGAAGCT TATCGTTTGGAT AGGTATGACAAC | ssRNA 1 | fig. S10B |
| PsmCas13b spacer test 30 nt | PsmCas13b | CTACCAAGTAATCCATATT TCTAGAGGATCGTTGTAGA AGCTTATCGTTTGGATAGG TATGACAAC | CTACCAAG TAATCCAT ATTTCTAG AGGATC | GTTGTAGAAGCT TATCGTTTGGAT AGGTATGACAAC | ssRNA 1 | fig. S10B |
| PsmCas13b spacer test 29 nt | PsmCas13b | TACCAAGTAATCCATATTT CTAGAGGATCGTTGTAGAA GCTTATCGTTTGGATAGGT ATGACAAC | TACCAAGT AATCCATA TTTCTAGA GGATC | GTTGTAGAAGCT TATCGTTTGGAT AGGTATGACAAC | ssRNA 1 | fig. S10B |
| PsmCas13b spacer test 28 nt | PsmCas13b | ACCAAGTAATCCATATTTC TAGAGGATCGTTGTAGAAG CTTATCGTTTGGATAGGTA TGACAAC | ACCAAGTA ATCCATAT TTCTAGAG GATC | GTTGTAGAAGCT TATCGTTTGGAT AGGTATGACAAC | ssRNA 1 | fig. S10B |
| PsmCas13b spacer test 27 nt | PsmCas13b | CCAAGTAATCCATATTTCT AGAGGATCGTTGTAGAAGC TTATCGTTTGGATAGGTAT GACAAC | CCAAGTAA TCCATATT TCTAGAGG ATC | GTTGTAGAAGCT TATCGTTTGGAT AGGTATGACAAC | ssRNA 1 | fig. S10B |
| PsmCas13b spacer test 26 nt | PsmCas13b | CAAGTAATCCATATTTCTA GAGGATCGTTGTAGAAGCT TATCGTTTGGATAGGTATG ACAAC | CAAGTAAT CCATATTT CTAGAGGA TC | GTTGTAGAAGCT TATCGTTTGGAT AGGTATGACAAC | ssRNA 1 | fig. S10B |
| PsmCas13b spacer test 25 nt | PsmCas13b | AAGTAATCCATATTTCTAG AGGATCGTTGTAGAAGCTT ATCGTTTGGATAGGTATGA CAAC | AAGTAATC CATATTTC TAGAGGAT C | GTTGTAGAAGCT TATCGTTTGGAT AGGTATGACAAC | ssRNA 1 | fig. S10B |
| PsmCas13b spacer test 24 nt | PsmCas13b | AGTAATCCATATTTCTAGA GGATCGTTGTAGAAGCTTA TCGTTTGGATAGGTATGAC AAC | AGTAATCC ATATTTCT AGAGGATC | GTTGTAGAAGCT TATCGTTTGGAT AGGTATGACAAC | ssRNA 1 | fig. S10B |
| PsmCas13b spacer test 23 nt | PsmCas13b | GTAATCCATATTTCTAGAG GATCGTTGTAGAAGCTTAT CGTTTGGATAGGTATGACA AC | GTAATCCA TATTTCTA GAGGATC | GTTGTAGAAGCT TATCGTTTGGAT AGGTATGACAAC | ssRNA 1 | fig. S10B |
| PsmCas13b spacer test 22 nt | PsmCas13b | TAATCCATATTTCTAGAGG ATCGTTGTAGAAGCTTATC GTTTGGATAGGTATGACAA C | TAATCCAT ATTTCTAG AGGATC | GTTGTAGAAGCT TATCGTTTGGAT AGGTATGACAAC | ssRNA 1 | fig. S10B |
| PsmCas13b spacer test 21 nt | PsmCas13b | AATCCATATTTCTAGAGGA TCGTTGTAGAAGCTTATCG TTTGGATAGGTATGACAAC | AATCCATA TTTCTAGA GGATC | GTTGTAGAAGCT TATCGTTTGGAT AGGTATGACAAC | ssRNA 1 | fig. S10B |
| PsmCas13b spacer test 20 nt | PsmCas13b | ATCCATATTTCTAGAGGAT CGTTGTAGAAGCTTATCGT TTGGATAGGTATGACAAC | ATCCATAT TTCTAGAG GATC | GTTGTAGAAGCT TATCGTTTGGAT AGGTATGACAAC | ssRNA 1 | fig. S10B |
| PsmCas13b spacer test 19 nt | PsmCas13b | TCCATATTTCTAGAGGATC GTTGTAGAAGCTTATCGTT TGGATAGGTATGACAAC | TCCATATT TCTAGAGG ATC | GTTGTAGAAGCT TATCGTTTGGAT AGGTATGACAAC | ssRNA 1 | fig. S10B |
| PsmCas13b spacer test 18 nt | PsmCas13b | CCATATTTCTAGAGGATCG TTGTAGAAGCTTATCGTTT GGATAGGTATGACAAC | CCATATTT CTAGAGGA TC | GTTGTAGAAGCT TATCGTTTGGAT AGGTATGACAAC | ssRNA 1 | fig. S10B |
| PsmCas13b spacer test 17 nt | PsmCas13b | CATATTTCTAGAGGATCGT TGTAGAAGCTTATCGTTTG GATAGGTATGACAAC | CATATTTC TAGAGGAT C | GTTGTAGAAGCT TATCGTTTGGAT AGGTATGACAAC | ssRNA 1 | fig. S10B |

FIG. 40 cont.

| Name | Protein | Sequence 1 | Sequence 2 | Sequence 3 | Target | Figure |
|---|---|---|---|---|---|---|
| PsmCas13b spacer test 16 nt | PsmCas13b | ATATTTCTAGAGGATCGTT GTAGAAGCTTATCGTTTGG ATAGGTATGACAAC | ATATTTCT AGAGGATC | GTTGTAGAAGCT TATCGTTTGGAT AGGTATGACAAC | ssRNA 1 | fig. S10B |
| PsmCas13b spacer test 15 nt | PsmCas13b | TATTTCTAGAGGATCGTTG TAGAAGCTTATCGTTTGGA TAGGTATGACAAC | TATTTCTA GAGGATC | GTTGTAGAAGCT TATCGTTTGGAT AGGTATGACAAC | ssRNA 1 | fig. S10B |
| PsmCas13b spacer test 14 nt | PsmCas13b | ATTTCTAGAGGATCGTTGT AGAAGCTTATCGTTTGGAT AGGTATGACAAC | ATTTCTAG AGGATC | GTTGTAGAAGCT TATCGTTTGGAT AGGTATGACAAC | ssRNA 1 | fig. S10B |
| PsmCas13b spacer test 13 nt | PsmCas13b | TTTCTAGAGGATCGTTGTA GAAGCTTATCGTTTGGATA GGTATGACAAC | TTTCTAGA GGATC | GTTGTAGAAGCT TATCGTTTGGAT AGGTATGACAAC | ssRNA 1 | fig. S10B |
| PsmCas13b spacer test 12 nt | PsmCas13b | TTCTAGAGGATCGTTGTAG AAGCTTATCGTTTGGATAG GTATGACAAC | TTCTAGAG GATC | GTTGTAGAAGCT TATCGTTTGGAT AGGTATGACAAC | ssRNA 1 | fig. S10B |
| LwaCas13a tiling crRNA 1 | LwaCas13a | GATTTAGACTACCCCAAAA ACGAAGGGGACTAAAACCC GGGTACCGAGCTCGAATTC ACTGGCC | CCGGGTAC CGAGCTCG AATTCACT GGCC | GATTTAGACTAC CCCAAAAACGAA GGGGACTAAAAC | ssRNA 1 | fig. S11 |
| LwaCas13a tiling crRNA 2 | LwaCas13a | GATTTAGACTACCCCAAAA ACGAAGGGGACTAAAACTT TCTAGAGGATCCCCGGGTA CCGAGCT | TTTCTAGA GGATCCCC GGGTACCG AGCT | GATTTAGACTAC CCCAAAAACGAA GGGGACTAAAAC | ssRNA 1 | fig. S11 |
| LwaCas13a tiling crRNA 3 | LwaCas13a | GATTTAGACTACCCCAAAA ACGAAGGGGACTAAAACCC AAGTAATCCATATTTCTAG AGGATCC | CCAAGTAA TCCATATT TCTAGAGG ATCC | GATTTAGACTAC CCCAAAAACGAA GGGGACTAAAAC | ssRNA 1 | fig. S11 |
| LwaCas13a tiling crRNA 4 | LwaCas13a | GATTTAGACTACCCCAAAA ACGAAGGGGACTAAAACAG ATTGCTGTTCTACCAAGTA ATCCATA | AGATTGCT GTTCTACC AAGTAATC CATA | GATTTAGACTAC CCCAAAAACGAA GGGGACTAAAAC | ssRNA 1 | fig. S11 |
| LwaCas13a tiling crRNA 5 | LwaCas13a | GATTTAGACTACCCCAAAA ACGAAGGGGACTAAAACCC TGCAGGTCGAGTAGATTGC TGTTCTA | CCTGCAGG TCGAGTAG ATTGCTGT TCTA | GATTTAGACTAC CCCAAAAACGAA GGGGACTAAAAC | ssRNA 1 | fig. S11 |
| LwaCas13a tiling crRNA 6 | LwaCas13a | GATTTAGACTACCCCAAAA ACGAAGGGGACTAAAACCC CAAGCTTGCATGCCTGCAG GTCGAGT | GCCAAGCT TGCATGCC TGCAGGTC GAGT | GATTTAGACTAC CCCAAAAACGAA GGGGACTAAAAC | ssRNA 1 | fig. S11 |
| LwaCas13a tiling crRNA 7 | LwaCas13a | GATTTAGACTACCCCAAAA ACGAAGGGGACTAAAACAT GACCATGATTACGCCAAGC TTGCATG | ATGACCAT GATTACGC CAAGCTTG CATG | GATTTAGACTAC CCCAAAAACGAA GGGGACTAAAAC | ssRNA 1 | fig. S11 |
| LwaCas13a tiling crRNA 8 | LwaCas13a | GATTTAGACTACCCCAAAA ACGAAGGGGACTAAAACCA CAGGAAACAGCTATGACCA TGATTAC | CACAGGAA ACAGCTAT GACCATGA TTAC | GATTTAGACTAC CCCAAAAACGAA GGGGACTAAAAC | ssRNA 1 | fig. S11 |
| LwaCas13a tiling crRNA 9 | LwaCas13a | GATTTAGACTACCCCAAAA ACGAAGGGGACTAAAACTG TGAGCGGATAAACACAGGA AACAGCT | TGTGAGCG GATAAACA CAGGAAAC AGCT | GATTTAGACTAC CCCAAAAACGAA GGGGACTAAAAC | ssRNA 1 | fig. S11 |
| LwaCas13a tiling crRNA 10 | LwaCas13a | GATTTAGACTACCCCAAAA ACGAAGGGGACTAAAACAT GTTGTGGAATTGTGAGCGG ATAAA | ATGTTGTG GAATTGTG AGCGGATA AAA | GATTTAGACTAC CCCAAAAACGAA GGGGACTAAAAC | ssRNA 1 | fig. S11 |
| LwaCas13a tiling crRNA 11 | LwaCas13a | GATTTAGACTACCCCAAAA ACGAAGGGGACTAAAACTG CTTCCGGCTCGTATGTTGT GGAAT | TGCTTCCG GCTCGTAT GTTGTGGA AAT | GATTTAGACTAC CCCAAAAACGAA GGGGACTAAAAC | ssRNA 1 | fig. S11 |
| CcaCas13b tiling crRNA 1 | CcaCas13b | CCCCGGGTACCGAGCTCGA ATTCACTGGCCGTTGGAAC TGCTCTCATTTTGGAGGGT AATCACAAC | CCCGGGT ACCGAGCT CGAATTCA CTGCC | GTTGGAACTGCT CTCATTTTGGAG GGTAATCACAAC | ssRNA 1 | fig. S11 |
| CcaCas13b tiling crRNA 2 | CcaCas13b | TATTTCTAGAGGATCCCCG GGTACCGAGCTCGTTGGAAC TGCTCTCATTTTGGAGGGT AATCACAAC | TATTTCTA GAGGATCC CCGGGTAC CGAGCT | GTTGGAACTGCT CTCATTTTGGAG GGTAATCACAAC | ssRNA 1 | fig. S11 |
| CcaCas13b tiling crRNA 3 | CcaCas13b | TACCAAGTAATCCATATTT CTAGAGGATCCGTTGGAAC TGCTCTCATTTTGGAGGGT AATCACAAC | TACCAAGT AATCCATA TTTCTAGA GGATCC | GTTGGAACTGCT CTCATTTTGGAG GGTAATCACAAC | ssRNA 1 | fig. S11 |
| CcaCas13b tiling crRNA 4 | CcaCas13b | GTAGATTGCTGTTCTACCA AGTAATCCATAGTTGGAAC TGCTCTCATTTTGGAGGGT AATCACAAC | GTAGATTG CTGTTCTA CCAAGTAA TCCATA | GTTGGAACTGCT CTCATTTTGGAG GGTAATCACAAC | ssRNA 1 | fig. S11 |
| CcaCas13b tiling crRNA 5 | CcaCas13b | TGCCTGCAGGTCGAGTAGA TTGCTGTTCTAGGTTGGAAC TGCTCTCATTTTGGAGGGT AATCACAAC | TGCCTGCA GGTCGAGT AGATTGCT GTTCTA | GTTGGAACTGCT CTCATTTTGGAG GGTAATCACAAC | ssRNA 1 | fig. S11 |
| CcaCas13b tiling crRNA 6 | CcaCas13b | ACGCCAAGCTTGCATGCCT GCAGGTCGAGTGTTGGAAC TGCTCTCATTTTGGAGGGT AATCACAAC | ACGCCAAG CTTGCATG CCTGCAGG TCGAGT | GTTGGAACTGCT CTCATTTTGGAG GGTAATCACAAC | ssRNA 1 | fig. S11 |
| CcaCas13b tiling crRNA 7 | CcaCas13b | CTATGACCATGATTACGCC AAGCTTGCATGCCTGGAAC | CTATGACC ATGATTAC | GTTGGAACTGCT CTCATTTTGGAG GGTAATCACAAC | ssRNA 1 | fig. S11 |

FIG. 40 cont.

| | | | | | | |
|---|---|---|---|---|---|---|
| | | TGCTCTCATTTTGGAGGGT AATCACAAC | GCCAAGCT TGCATG | | | |
| CcaCas13b tiling crRNA 8 | CcaCas13b | AACACAGGAAACAGCTATG ACCATGATTACGTTGGAAC TGCTCTCATTTTGGAGGGT AATCACAAC | AACACAGG AAACAGCT ATGACCAT GATTAC | GTTGGAACTGCT CTCATTTTGGAG GGTAATCACAAC | ssRNA 1 | fig. S11 |
| CcaCas13b tiling crRNA 9 | CcaCas13b | ATTGTGAGCGGATAAACAC AGGAAACAGCTGTTGGAAC TGCTCTCATTTTGGAGGGT AATCACAAC | ATTGTGAG CGGATAAA CACAGGAA ACAGCT | GTTGGAACTGCT CTCATTTTGGAG GGTAATCACAAC | ssRNA 1 | fig. S11 |
| CcaCas13b tiling crRNA 10 | CcaCas13b | GTATGTTGTGTGGAATTGT GAGCGGATAAAGTTGGAAC TGCTCTCATTTTGGAGGGT AATCACAAC | GTATGTTG TGTGGAAT TGTGAGCG GATAAA | GTTGGAACTGCT CTCATTTTGGAG GGTAATCACAAC | ssRNA 1 | fig. S11 |
| CcaCas13b tiling crRNA 11 | CcaCas13b | TATGCTTCCGGCTCGTATG TTGTGTGGAATGTTGGAAC TGCTCTCATTTTGGAGGGT AATCACAAC | TATGCTTC CGGCTCGT ATGTTGTG TGGAAT | GTTGGAACTGCT CTCATTTTGGAG GGTAATCACAAC | ssRNA 1 | fig. S11 |
| PsmCas13b tiling crRNA 1 | PsmCas13b | CCCCGGGTACCGAGCTCGA ATTCACTGGCCGTTGTAGA AGCTTATCGTTTGGATAGG TATGACAAC | CCCCGGGT ACCGAGCT CGAATTCA CTGGCC | GTTGTAGAAGCT TATCGTTTGGAT AGGTATGACAAC | ssRNA 1 | fig. S11 |
| PsmCas13b tiling crRNA 2 | PsmCas13b | TATTTCTAGAGGATCCCCG GGTACCGAGCTGTTGTAGA AGCTTATCGTTTGGATAGG TATGACAAC | TATTTCTA GAGGATCC CCGGGTAC CGAGCT | GTTGTAGAAGCT TATCGTTTGGAT AGGTATGACAAC | ssRNA 1 | fig. S11 |
| PsmCas13b tiling crRNA 3 | PsmCas13b | TACCAAGTAATCCATATTT CTAGAGGATCCGTTGTAGA AGCTTATCGTTTGGATAGG TATGACAAC | TACCAAGT AATCCATA TTTCTAGA GGATCC | GTTGTAGAAGCT TATCGTTTGGAT AGGTATGACAAC | ssRNA 1 | fig. S11 |
| PsmCas13b tiling crRNA 4 | PsmCas13b | CTAGATTGCTGTTCTACCA AGTAATCCATAGTTGTAGA AGCTTATCGTTTGGATAGG TATGACAAC | CTAGATTG CTGTTCTA CCAAGTAA TCCATA | GTTGTAGAAGCT TATCGTTTGGAT AGGTATGACAAC | ssRNA 1 | fig. S11 |
| PsmCas13b tiling crRNA 5 | PsmCas13b | TGCCTGCAGGTCGACTGGA TTGCTGTTCTAGTTGTAGA AGCTTATCGTTTGGATAGG TATGACAAC | TGCCTGCA GGTCGACT GGATTGCT GTTCTA | GTTGTAGAAGCT TATCGTTTGGAT AGGTATGACAAC | ssRNA 1 | fig. S11 |
| PsmCas13b tiling crRNA 6 | PsmCas13b | ACGCCAAGCTTGCATGCCT GCAGGTCGAGTGTTGTAGA AGCTTATCGTTTGGATAGG TATGACAAC | ACGCCAAG CTTGCATG CCTGCAGG TCGAGT | GTTGTAGAAGCT TATCGTTTGGAT AGGTATGACAAC | ssRNA 1 | fig. S11 |
| PsmCas13b tiling crRNA 7 | PsmCas13b | CTATGACCATGATTACGCC AAGCTTGCATGGTTGTAGA AGCTTATCGTTTGGATAGG TATGACAAC | CTATGACC ATGATTAC GCCAAGCT TGCATG | GTTGTAGAAGCT TATCGTTTGGAT AGGTATGACAAC | ssRNA 1 | fig. S11 |
| PsmCas13b tiling crRNA 8 | PsmCas13b | AACACAGGAAACAGCTATG ACCATGATTACGTTGTAGA AGCTTATCGTTTGGATAGG TATGACAAC | AACACAGG AAACAGCT ATGACCAT GATTAC | GTTGTAGAAGCT TATCGTTTGGAT AGGTATGACAAC | ssRNA 1 | fig. S11 |
| PsmCas13b tiling crRNA 9 | PsmCas13b | ATTGTGAGCGGATAAACAC AGGAAACAGCTGTTGTAGA AGCTTATCGTTTGGATAGG TATGACAAC | ATTGTGAG CGGATAAA CACAGGAA ACAGCT | GTTGTAGAAGCT TATCGTTTGGAT AGGTATGACAAC | ssRNA 1 | fig. S11 |
| PsmCas13b tiling crRNA 10 | PsmCas13b | GTATGTTGTGTGGAATTGT GAGCGGATAAAGTTGTAGA AGCTTATCGTTTGGATAGG TATGACAAC | GTATGTTG TGTGGAAT TGTGAGCG GATAAA | GTTGTAGAAGCT TATCGTTTGGAT AGGTATGACAAC | ssRNA 1 | fig. S11 |
| PsmCas13b tiling crRNA 11 | PsmCas13b | TATGCTTCCGGCTCGTATG TTGTGTGGAATGTTGTAGA AGCTTATCGTTTGGATAGG TATGACAAC | TATGCTTC CGGCTCGT ATGTTGTG TGGAAT | GTTGTAGAAGCT TATCGTTTGGAT AGGTATGACAAC | ssRNA 1 | fig. S11 |
| ZIKV CcaCas13b | CcaCas13b | CTTGAACTCTACCAGTGCT TCTTTGTTGTTGGAAC TGCTCTCATTTTGGAGGGT AATCACAAC | CTTGAACT CTACCAGT GCTTCTTT GTTGTT | GTTGGAACTGCT CTCATTTTGGAG GGTAATCACAAC | ZIKV ssRNA | fig. S16B |
| DENV crRNA CcaCas13b | CcaCas13b | TTTGCTTCTGTCCAGTGGA CATGGTCTTCGGTTGGAAC TGCTCTCATTTTGGAGGGT AATCACAAC | TTTGCTTC TGTCCAGT GGACATGG TCTTCG | GTTGGAACTGCT CTCATTTTGGAG GGTAATCACAAC | DENV ssRNA | fig. S17A |
| human ID rs601338 A- allele sensing PsmCas13b | PsmCas13b | CCGCTTCACCGGCTACCCC TGCTCCAAGAGTTGTAGAA GCTTATCGTTTGGATAGGT ATGACAAC | CCGCTTCA CCGGCTAC CCCTGCTC CAAGA | GTTGTAGAAGCT TATCGTTTGGAT AGGTATGACAAC | Human locus rs601338 | fig. S18C |
| human ID rs601338 G- allele sensing LwaCas13a | LwaCas13a | GATTTAGACTACCCCAAAA ACGAAGGGGACTAAAACCT GCACCTTCTACCACCACCT CCGCCAG | CTGCACCT TCTACCAC CACCTCCG CCAG | GATTTAGACTAC CCCAAAAACGAA GGGGACTAAA | Human locus rs601338 | fig. S18C |
| ssRNA/ssDNA 1 crRNA 1 | LwaCas13a | GATTTAGACTACCCCAAAA ACGAAGGGGACTAAAACTA | TAGATTGC TGTTCTAC | GATTTAGACTAC CCCAAAAACGAA GGGGACTAAA | ssRNA 1 | fig. S20 |

FIG. 40 cont.

| | | | | | | |
|---|---|---|---|---|---|---|
| | | GATTGCTGTTCTACCAAGT AATCCAT | CAAGTAAT CCAT | | | |
| T790M mutant sensing allele crRNA | LwaCas13a | GATTTAGACTACCCCAAAA ACGAAGGGGACTAAAACGC AAGATGAGCTGCACGGTGG AGGTGAG | GCAAGATG AGCTGCAC GGTGGAGG TGAG | GATTTAGACTAC CCCAAAAACGAA GGGGACTAAAAC | EGFR T790M mutant synthetic ssDNA | fig. S24 |
| T790M wild type sensing allele crRNA | LwaCas13a | GATTTAGACTACCCCAAAA ACGAAGGGGACTAAAACGC GTCATGAGCTGCACGGTGG AGGTGAG | GCGTCATG AGCTGCAC GGTGGAGG TGAG | GATTTAGACTAC CCCAAAAACGAA GGGGACTAAAAC | EGFR T790M WT synthetic ssDNA | fig. S24 |
| ssRNA 3 (PsmCas13b target) crRNA | PsmCas13b | TAGATTGCTGTTCTACCAA GTAATCCATATGTGTAGA AGCTTATCGTTTGGATAGG TATGACAAC | TAGATTGC TGTTCTAC CAAGTAAT CCATAT | GTTGTAGAAGCT TATCGTTTGGAT AGGTATGACAAC | ssRNA 3 | fig. S25 |
| ssRNA 2 (LwaCas13a target) crRNA | LwaCas13a | GATTTAGACTACCCCAAAA ACGAAGGGGACTAAAACGA TTGCTGTTCTACCAAGTAA TCCATAT | GATTGCTG TTCTACCA AGTAATCC ATAT | GATTTAGACTAC CCCAAAAACGAA GGGGACTAAAAC | ssRNA 2 | fig. S25 |

FIG. 40 cont.

| Name | Sequence | Nucleic acid | 1st Fig. |
|---|---|---|---|
| DENV ssRNA | AGUACAUAUUCAGGGGCCAACCUCUCAACAAUGACGAAGACCAUGCUC ACUGGACAGAAGCAAAAAUGCUGCUGGACAACAUCAACACACCAGAAG GGAUUAUACCAGCUCUCUUUGAACCAGAAAGGGAGAAGUCAGCCGCCA UAGACGGUGAAUACCGCCUGAAGGGU | RNA | Fig. 1B |
| ssDNA 1 | GGCCAGTGAATTCGAGCTCGGTACCCGGGGATCCTCTAGAAATATGGA TTACTTGgtAGAACAGCAATCTACTCGACCTGCAGGCATGCAAGCTTG GCGTAATCATGGTCATAGCTGTTTCCTGTGTTTATCCGCTCACAATTC CACACAACATACGAGCCGGAAGCATAAAG | DNA | Fig. 1F |
| ZIKV ssRNA | GACACCGGAACUCCACACUGGAACAACAAAGAAGCACUGGUAGAGUUC AAGGACGCACAUGCCAAAAGGCAAACUGUCGUGGUUCUAGGGAGUCAA GAAGGAGCAGUUCACACGGCCCUUGCUGGAGCUCUGGSAGGCUGAGAUU GAUGGUGCAAAGGGAAGGCUGUCCUCUGGC | RNA | Fig. 1F |
| Thermonuclease ssDNA | TTAATTAAAGCGATTGATGGTGATACTGTTAAATTAATGTACAAAGGT CAACCAATGACATTCAGACTATTATTGGTTGATACACCTGAAACAAAG CATCCTAAAAAAGGTGTAGAGAAATATGGTCCTGAAGCAAGTGCATTT ACGAAAAAGATGGTAGAAAATGCAAAGAAAATTGAAGTCGAGTTTG | DNA | Fig. 1H |
| Acyltransferase ssDNA | GGGGAGGATGTCGGGCGCGCACGTTTTCCCTTCGCTGAGCACGCTGCG CGCGTCGCCTACGTGAATGCGCGTTCGATGCGTTGGCCGAAGGCAAC CCGCGGGTGAGCGTGCTCGACCCCTCCAGCGTGCTCTGCGATGGCCTG GATTGTTTCGCCGAACGTGATGGCTGGTCGCTGTACATGGATAACA | DNA | Fig. 1H |
| ssRNA 1 | GGCCAGUGAAUUCGAGCUCGGUACCCGGGGAUCCUCUAGAAAUAUGGA UUACUUGgtAGAACAGCAAUCUACUCGACCUGCAGGCAUGCAAGCUUG GCGUAAUCAUGGUCAUAGCUGUUUCCUGUGUUUAUCCGCUCACAAUUC CACACAACAUACGAGCCGGAAGCAUAAAG | RNA | fig. S3 |
| Random motif library | TTCCTGTGAAGCTAAAGAAGGAGAATGrNrNrNrNrNTATTGATAG CAGCTGTGGCACCTGCAC | Mixed DNA/RNA | fig. S12 |
| EGFR Exon19 deletion mutant synthetic ssDNA | TGCCAGTTAACGTCTTCCTTCTCTCTCTGTCATAGGGACTCTGGATCC CAGAAGGTGAGAAAGTTAAAATTCCCGTCGCTATCAAGACATCTCCGA AAGCCAACAAGGAAATCCTCGATGTGAGTTTCTGCTTTGCTGTGTGGG GGTCCATGGCTCTGAACCTCAGGCCCACCTTTTCTCAT | DNA | fig. S24A |
| EGFR Exon19 deletion WT synthetic ssDNA | TGCCAGTTAACGTCTTCCTTCTCTCTCTGTCATAGGGACTCTGGATCC CAGAAGGTGAGAAAGTTAAAATTCCCGTCGCTATCAAGGAATTAAGAG AAGCAACATCTCCGAAAGCCAACAAGGAAATCCTCGATGTGAGTTTCT GCTTTGCTGTGTGGGGTCCATGGCTCTGAACCTCAGGCCCACCTTTT CTCAT | DNA | fig. S24A |
| EGFR T790M mutant synthetic ssDNA | CCTCCCTCCAGGAAGCCTACGTGATGGCCAGCGTGGACAACCCCCACG TGTGCCGCCTGCTGGGCATCTGCCTCACCTCCACCGTGCAGCTCATCA TGCAGCTCATGCCCTTCGGCTGCCTCCTGGACTATGTCCGGGAACACA AAGACAATATTGGCTCCCAGTACCTGCTCAACTGGTGTGTGCAGATCG CA | DNA | fig. S24E |
| EGFR T790M WT synthetic ssDNA | CCTCCCTCCAGGAAGCCTACGTGATGGCCAGCGTGGACAACCCCCACG TGTGCCGCCTGCTGGGCATCTGCCTCACCTCCACCGTGCAGCTCATCA CGCAGCTCATGCCCTTCGGCTGCCTCCTGGACTATGTCCGGGAACACA AAGACAATATTGGCTCCCAGTACCTGCTCAACTGGTGTGTGCAGATCG CA | DNA | fig. S24E |
| ssRNA 2 (LwaCas13a target) | UAGGUGUUCCACAGGGUAGCCAGCAGCAUCCUGCGAUGCAAAUAUGGA UUACUUGGUAGAACAGCAAUCUAAUCCGGAACAUAAUGGUGCAGGGCG CUGACUUUCCGCGUUUGUUUAAAUCAAACACGGAAACCGAAGACCAUU CAUGUUGUUGCUGCCGGAAGCAUAAAG | RNA | fig. S25B |
| ssRNA 3 (PsmCas13b target) | UAGGUGUUCCACAGGGUAGCCAGCAGCAUCCUGCGAUGCAAAUAUGGA UUACUUGGUAGAACAGCAAUCUAAUCCGGAACAUAAUGGUGCAGGGCG CUGACUUUCCGCGUUUGAAAAAAACAAACACGGAAACCGAAGACCAUU CAUGUUGUUGCUGCCGGAAGCAUAAAG | RNA | fig. S25B |

FIG. 41

| Target | Forward primer sequence | Forward primer sequence (with T7 RNAP promoter) | Reverse primer sequence | 1st Fig. |
|---|---|---|---|---|
| DENV ssRNA | GTACATATTCAGGGGCCAACCTCTC | gaaattaatacgactcactataggg GTACATATTCAGGGGCCAACCTCTC | TTTCTGGTTCAAAG AGAGCTGGTAT | Fig. 1D |
| Thermonuclease ssDNA | TGTACAAAGGTCAACCAATGACATTCAG | gaaatTAATACGACTCACTATAGGG TGTACAAAGGTCAACCAATGACATTCAG | TGCACTTGCTTCAG GACCATATTTC | Fig. 1H |
| Acyltransferase | CTACGTGAATGCGCTGTTCGATG | gaaatTAATACGACTCACTATAGGG CTACGTGAATGCGCTGTTCGATG | GAAACAATCCAGGC CATCGCAGAG | Fig. 1H |
| EGFR L858R | TCTGGATCCCAGAAGGTGAGAAA GTTAAAA | gaaatTAATACGACTCACTATAGGG TCTGGATCCCAGAAGGTGAGAAAGT TAAAA | CCACACAGCAAAGC AGAAACTCACATCG AG | Fig. 3E |
| EGFR Exon19 deletion | TCTGGATCCCAGAAGGTGAGAAA GTTAAAA | gaaatTAATACGACTCACTATAGGG TCTGGATCCCAGAAGGTGAGAAAGT TAAAA | CCACACAGCAAAGC AGAAACTCACATCG AG | Fig. 3H |
| Theranostic APC target (NM_000038.5) | AGGGCCGCCACTCCACCGGCGGC ATGGATGAG | gaaatTAATACGACTCACTATAGGG AGGGCCGCCACTCCACCGGCGGCAT GGATGAG | GAAGAGTTCTTCAC CTTTACTCACggaT CCtcc | Fig. 5B |
| ZIKV ssRNA | CCACACTGGAACAACAAAGAAGC AC | gaaatTAATACGACTCACTATAGGG CCACACTGGAACAACAAAGAAGCAC | ACAGCCTTCCCTTT GCACCATCCATCTC AG | fig. S6 |
| locus rs601338 | ATAGTCCCCTCGGCGAACATGGA CCCCTACAA | gaaattaatacgactcactataggg ATAGTCCCCTCGGCGAACATGGACC CCTACAA | GAGTACGTCCGCTT CACCGGCTACCCCT GCTC | fig. S18C |
| ssDNA/ssRNA 1 | ATCCTCTAGAAATATGGATTACT TGGTAGAACAG | AATTCTAATACGACTCACTATAGGG ATCCTCTAGAAATATGGATTACTTG GTAGAACAG | GATAAACACAGGAA ACAGCTATGACCAT GATTACG | fig. S20 |
| EGFR T790M | CCCCACGTGTGCCGCCTGCTGGG CATCTGC | gaaatTAATACGACTCACTATAGGG CCCCACGTGTGCCGCCTGCTGGGCA TCTGC | ATATTGTCTTTGTG TTCCCGGACATAGT CC | fig. S24E |

FIG. 42

| Name | Sequence | Fluorophore | 1st Fig. |
|---|---|---|---|
| poly U reporter | /56-FAM/rUrUrUrUrU/3IABkFQ/ | FAM | Fig. 1 |
| poly A reporter | /56-FAM/rArArArArA/3IABkFQ/ | FAM | Fig. 1 |
| poly U reporter for multiplexing | /5HEX/rUrUrUrUrU/3IABkFQ/ | HEX | Fig. 1 |
| rArA reporter for testing di-base preference | /56-FAM/TArArAGC/3IABkFQ/ | FAM | Fig. 1 and fig. S7 |
| rArU reporter for testing di-base preference | /56-FAM/TArArUGC/3IABkFQ/ | FAM | Fig. 1 and fig. S7 |
| rArC reporter for testing di-base preference | /56-FAM/TArArCGC/3IABkFQ/ | FAM | Fig. 1 and fig. S7 |
| rArG reporter for testing di-base preference | /56-FAM/TArArGGC/3IABkFQ/ | FAM | Fig. 1 and fig. S7 |
| rUrA reporter for testing di-base preference | /56-FAM/TArUrAGC/3IABkFQ/ | FAM | Fig. 1 and fig. S7 |
| rUrU reporter for testing di-base preference | /56-FAM/TArUrUGC/3IABkFQ/ | FAM | Fig. 1 and fig. S7 |
| rUrC reporter for testing di-base preference | /56-FAM/TArUrCGC/3IABkFQ/ | FAM | Fig. 1 and fig. S7 |
| rUrG reporter for testing di-base preference | /56-FAM/TArUrGGC/3IABkFQ/ | FAM | Fig. 1 and fig. S7 |
| rCrA reporter for testing di-base preference | /56-FAM/TArCrAGC/3IABkFQ/ | FAM | Fig. 1 and fig. S7 |
| rCrU reporter for testing di-base preference | /56-FAM/TArCrUGC/3IABkFQ/ | FAM | Fig. 1 and fig. S7 |
| rCrC reporter for testing di-base preference | /56-FAM/TArCrCGC/3IABkFQ/ | FAM | Fig. 1 and fig. S7 |
| rCrG reporter for testing di-base preference | /56-FAM/TArCrGGC/3IABkFQ/ | FAM | Fig. 1 and fig. S7 |
| rGrA reporter for testing di-base preference | /56-FAM/TArGrAGC/3IABkFQ/ | FAM | Fig. 1 and fig. S7 |
| rGrU reporter for testing di-base preference | /56-FAM/TArGrUGC/3IABkFQ/ | FAM | Fig. 1 and fig. S7 |
| rGrC reporter for testing di-base preference | /56-FAM/TArGrCGC/3IABkFQ/ | FAM | Fig. 1 and fig. S7 |
| rGrG reporter for testing di-base preference | /56-FAM/TArGrGGC/3IABkFQ/ | FAM | Fig. 1 and fig. S7 |
| poly U Cy5 for multiplexing | /5Cy5/rUrUrUrUrU/3IAbRQSp/ | FAM | Fig. 1 |
| Lateral flow reporter with FAM/Biotin | /56-FAM/mArArUrGrGrCnAmArArUrGrGrCmA/3Bio/ | N/A | Fig. 3 |
| poly C reporter | /56-FAM/rCrCrCrCrC/3IABkFQ/ | FAM | fig. S3 |
| poly G reporter | /56-FAM/rGrGrGrGrG/3IABkFQ/ | FAM | fig. S3 |
| RNA motif library for base preference screening | TTCCTGTGAAGCTAAAGAAGGAGAATGrNrNrNrNrNrNTATTGATAGCAGCTGTGGCACCTGCAC | N/A | fig. S12 |

FIG. 43

| | | | |
|---|---|---|---|
| LwaCas13a validation motif 1 | /56-FAM/TrGrUrUrUrC/3IABkFQ/ | FAM | fig. S13 |
| LwaCas13a validation motif 2 | /56-FAM/TrUrUrUrUrC/3IABkFQ/ | FAM | fig. S13 |
| LwaCas13a validation motif 3 | /56-FAM/TrCrArUrUrG/3IABkFQ/ | FAM | fig. S13 |
| PsmCas13b validation motif 1 | /56-FAM/TrUrArUrUrGrA/3IABkFQ/ | FAM | fig. S13 |
| PsmCas13b validation motif 2 | /56-FAM/TrArUrUrGrArU/3IABkFQ/ | FAM | fig. S13 |
| PsmCas13b validation motif 3 | /56-FAM/TrUrUrGrArArA/3IABkFQ/ | FAM | fig. S13 |
| CcaCas13b validation motif 1 | /56-FAM/TrUrUrUrGrUrU/3IABkFQ/ | FAM | fig. S13 |
| CcaCas13b validation motif 2 | /56-FAM/TrUrGrUrUrUrU/3IABkFQ/ | FAM | fig. S13 |
| CcaCas13b validation motif 3 | /56-FAM/TrArUrUrUrU/3IABkFQ/ | FAM | fig. S13 |
| Lwa orthogonal motif 1 | /56-FAM/TrCrGrArArG/3IABkFQ/ | FAM | fig. S14 |
| Lwa orthogonal motif 2 | /56-FAM/TrGrUrCrUrC/3IABkFQ/ | FAM | fig. S14 |
| Lwa orthogonal motif 3 | /56-FAM/TrCrCrArUrGrA/3IABkFQ/ | FAM | fig. S14 |
| Lwa orthogonal motif 4 | /56-FAM/TrCrArUrArCrA/3IABkFQ/ | FAM | fig. S14 |
| Lwa orthogonal motif 5 | /56-FAM/TrCrArUrArCrG/3IABkFQ/ | FAM | fig. S14 |
| Lwa orthogonal motif 6 | /56-FAM/TrGrCrArUrArA/3IABkFQ/ | FAM | fig. S14 |
| CcaCas13b orthogonal motif 1 | /56-FAM/TrCrUrArCrUrU/3IABkFQ/ | FAM | fig. S14 |
| CcaCas13b orthogonal motif 2 | /56-FAM/TrCrUrArCrGrU/3IABkFQ/ | FAM | fig. S14 |
| CcaCas13b orthogonal motif 3 | /56-FAM/TrUrUrArArArC/3IABkFQ/ | FAM | fig. S14 |
| gold nanoparticle linker | /5ThioMC6-D/rCrUrCrCrCrUrArArUrArArCrArArUrUrArUrArUrArArCrUrCrUrCrUrArCrCrCrUrUrUrCrCrArArArArCrArArA/3ThioMC3-D/ | N/A | fig. S21 |
| magnetic bead conjugate oligo | /5AmMC12/AGAGCATCACCATGATCCTGrUrUrUrUrUrUrUrUTG/iBiodT/CTCGGATATCTCGACTA/36-FAM/ | N/A | fig. S22 |
| EiCsm6 validation motif 1 | /56-FAM/TrGrArCrGrUrG/3IABkFQ/ | N/A | fig. S29 |
| short poly A for lateral flow | /FamCE/rArArArArArA/BioBB/ | N/A | fig. S34A |
| long poly A for lateral flow | /FamCE/rArArArArArArArArArArArArA/BioBB/ | N/A | fig. S34A |
| short poly C for lateral flow | /56-FAM/rCrCrCrCrCrC/3Bio/ | N/A | fig. S34A |
| long poly C for lateral flow | /56-FAM/rCrCrCrCrCrCrCrCrCrCrCrC/3Bio/ | N/A | fig. S34A |
| short poly A/C for lateral flow | /56-FAM/rArCrArCrArC/3Bio/ | N/A | fig. S34A |
| long poly A/C for lateral flow | /56-FAM/rArCrArCrArCrArCrArCrArC/3Bio/ | N/A | fig. S34A |

FIG. 43 cont.

MULTI-EFFECTOR CRISPR BASED DIAGNOSTIC SYSTEMS

CROSS REFERENCE TO RELATED APPLICATIONS

This application is a national phase entry of International Application Number PCT/US2018/050091 filed Sep. 7, 2018, which claims the benefit of U.S. Provisional Application No. 62/556,408, filed Sep. 9, 2017; U.S. Provisional Application No. 62/610,121, filed Dec. 22, 2017; and U.S. Provisional Application No. 62/630,808, filed Feb. 14, 2018. The entire contents of the above-identified applications are hereby fully incorporated herein by reference.

REFERENCE TO AN ELECTRONIC SEQUENCE LISTING

The contents of the electronic sequence listing (BROD_2277US_ST25.txt, 1,312,139 bytes, created on Sep. 7, 2018) is herein incorporated by reference in its entirety.

STATEMENT REGARDING FEDERALLY SPONSORED RESEARCH

This invention was made with government support under grant number MH110049 granted by the National Institutes of Health. The government has certain rights in the invention.

TECHNICAL FIELD

The subject matter disclosed herein is generally directed to rapid diagnostics related to the use of CRISPR effector systems.

BACKGROUND

Nucleic acids are a universal signature of biological information. The ability to rapidly detect nucleic acids with high sensitivity and single-base specificity on a portable platform has the potential to revolutionize diagnosis and monitoring for many diseases, provide valuable epidemiological information, and serve as a generalizable scientific tool. Although many methods have been developed for detecting nucleic acids (Du et al., 2017; Green et al., 2014; Kumar et al., 2014; Pardee et al., 2014; Pardee et al., 2016; Urdea et al., 2006), they inevitably suffer from trade-offs among sensitivity, specificity, simplicity, and speed. For example, qPCR approaches are sensitive but are expensive and rely on complex instrumentation, limiting usability to highly trained operators in laboratory settings. Other approaches, such as new methods combining isothermal nucleic acid amplification with portable platforms (Du et al., 2017; Pardee et al., 2016), offer high detection specificity in a point-of-care (POC) setting, but have somewhat limited applications due to low sensitivity. As nucleic acid diagnostics become increasingly relevant for a variety of healthcare applications, detection technologies that provide high specificity and sensitivity at low cost would be of great utility in both clinical and basic research settings.

SUMMARY

In one aspect, the present invention provides for a nucleic acid detection system comprising: a detection CRISPR system comprising: an effector protein, one or more guide RNAs designed to bind to corresponding target molecules, and one or more signal amplification CRISPR effector proteins; and one or more RNA-based masking constructs.

In another aspect, the present invention provides for a polypeptide detection system comprising: a detection CRISPR system comprising: an effector protein, one or more guide RNAs designed to bind to a trigger RNA, and one or more signal amplification CRISPR effector proteins; one or more RNA-based masking constructs; and one or more detection aptamers comprising a masked RNA polymerase promoter binding site or a masked primer binding site.

In certain embodiments, the one or more signal amplification CRISPR effector proteins comprise a Type IIIa CRISPR protein. The Type III CRISPR protein may be a Csm6 protein. The Csm6 protein may be selected from EiCsm6 and LsCsm6.

In certain embodiments, the one or more signal amplification CRISPR effector proteins comprise Csx28 or Csx27.

In certain embodiments, the one or more signal amplification CRISPR effector proteins comprises one or more of Csm6, Csx28, Csx27 or any combination thereof.

In certain embodiments, the system further comprises nucleic acid amplification reagents.

In certain embodiments, the target molecule is a target DNA and the system further comprises a primer that binds the target DNA and comprises an RNA polymerase promoter.

In certain embodiments, the CRISPR system effector protein is an RNA-targeting effector protein. The RNA-targeting effector protein may comprise one or more HEPN domains. The one or more HEPN domains may comprise a RxxxxH motif sequence. The RxxxxH motif may comprise a R{N/H/K}X$_1$X$_2$X$_3$H sequence. X$_1$ may be R, S, D, E, Q, N, G, or Y, and X$_2$ may be independently I, S, T, V, or L, and X$_3$ may be independently L, F, N, Y, V, I, S, D, E, or A.

In certain embodiments, the CRISPR RNA-targeting effector protein is C2c2. The C2c2 may be within 20 kb of a Cas 1 gene. The C2c2 effector protein may be from an organism of a genus selected from the group consisting of: *Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma, Campylobacter,* and *Lachnospira*. The C2c2 or Cas13b effector protein may be from an organism selected from the group consisting of: *Leptotrichia shahii; Leptotrichia wadei* (Lw2); *Listeria seeligeri; Lachnospiraceae bacterium* MA2020; *Lachnospiraceae bacterium* NK4A179; [*Clostridium*] *aminophilum* DSM 10710; *Carnobacterium gallinarum* DSM 4847; *Carnobacterium gallinarum* DSM 4847 (second CRISPR Loci); *Paludibacter propionicigenes* WB4; *Listeria weihenstephanensis* FSL R9-0317; *Listeriaceae bacterium* FSL M6-0635; *Leptotrichia wadei* F0279; *Rhodobacter capsulatus* SB 1003; *Rhodobacter capsulatus* R121; *Rhodobacter capsulatus* DE442; *Leptotrichia buccalis* C-1013-b; *Herbinix hemicellulosilytica;* [*Eubacterium*] *rectale; Eubacteriaceae bacterium* CHKCI004; *Blautia* sp. Marseille-P2398; *Leptotrichia* sp. *oral taxon* 879 str. F0557; *Lachnospiraceae bacterium* NK4A144; *Chloroflexus aggregans; Demequina aurantiaca; Thalassospira* sp. TSL5-1; *Pseudobutyrivibrio* sp. OR37; *Butyrivibrio* sp. YAB3001; *Blautia* sp. Marseille-P2398; *Leptotrichia* sp. Marseille-P3007; *Bacteroides ihuae; Porphyromonadaceae bacterium* KH3CP3RA; *List-

*eria riparia*; and *Insolitispirillum peregrinum*. The C2c2 effector protein may be a *L. wadei* F0279 or *L. wadei* F0279 (Lw2) C2c2 effector protein.

In certain embodiments, the one or more RNA-based masking constructs suppresses generation of a detectable positive signal.

In certain embodiments, the one or more RNA-based masking constructs may suppress generation of a detectable positive signal by masking the detectable positive signal, or generating a detectable negative signal instead.

In certain embodiments, the one or more RNA-based masking constructs may comprise a silencing RNA that suppresses generation of a gene product encoded by a reporting construct, wherein the gene product generates the detectable positive signal when expressed.

In certain embodiments, the one or more RNA-based masking constructs may be a ribozyme that generates the negative detectable signal, and wherein the positive detectable signal is generated when the ribozyme is deactivated. The ribozyme may convert a substrate to a first color and wherein the substrate converts to a second color when the ribozyme is deactivated.

In certain embodiments, the RNA-based masking agent is an RNA aptamer and/or comprises an RNA-tethered inhibitor.

The aptamer or RNA-tethered inhibitor may sequester an enzyme, wherein the enzyme generates a detectable signal upon release from the aptamer or RNA tethered inhibitor by acting upon a substrate. The aptamer may be an inhibitory aptamer that inhibits an enzyme and prevents the enzyme from catalyzing generation of a detectable signal from a substrate or wherein the RNA-tethered inhibitor inhibits an enzyme and prevents the enzyme from catalyzing generation of a detectable signal from a substrate. The enzyme may be thrombin, protein C, neutrophil elastase, subtilisin, horseradish peroxidase, beta-galactosidase, or calf alkaline phosphatase. The enzyme may be thrombin and the substrate may be para-nitroanilide covalently linked to a peptide substrate for thrombin, or 7-amino-4-methylcoumarin covalently linked to a peptide substrate for thrombin.

In certain embodiments, the aptamer sequesters a pair of agents that when released from the aptamers combine to generate a detectable signal.

In certain embodiments, the one or more RNA-based masking constructs comprises an RNA oligonucleotide to which a detectable ligand and a masking component are attached.

In certain embodiments, the one or more RNA-based masking constructs comprises a nanoparticle held in aggregate by bridge molecules, wherein at least a portion of the bridge molecules comprises RNA, and wherein the solution undergoes a color shift when the nanoparticle is disbursed in solution. The nanoparticle may be a colloidal metal. The colloidal metal may be colloidal gold.

In certain embodiments, the one or more RNA-based masking constructs comprises a quantum dot linked to one or more quencher molecules by a linking molecule, wherein at least a portion of the linking molecule comprises RNA.

In certain embodiments, the one or more RNA-based masking constructs comprises RNA in complex with an intercalating agent, wherein the intercalating agent changes absorbance upon cleavage of the RNA. The intercalating agent may be pyronine-Y or methylene blue.

In certain embodiments, the detectable ligand is a fluorophore and the masking component is a quencher molecule.

In certain embodiments, the one or more RNA-based masking constructs can be cleaved by the CRISPR RNA-targeting effector protein and Type IIIa CRISPR protein. In other words, the RNA-based masking agent may be a single construct that can be cleaved by the CRISPR RNA-targeting effector protein and Type IIIa CRISPR protein or more than one construct that can be cleaved by both, or more than one construct that can be cleaved by either or. The one or more RNA-based masking constructs may comprise a RNA-based masking construct that can be cleaved by the CRISPR RNA-targeting effector protein. The one or more RNA-based masking constructs may comprise a RNA-based masking construct that can be cleaved by the Type IIIa CRISPR protein. The one or more RNA-based masking constructs may comprise one RNA-based masking construct that can be cleaved by the CRISPR RNA-targeting effector protein and one RNA-based masking construct that can be cleaved by the Type IIIa CRISPR protein. The RNA-based masking construct that can be cleaved by the Type IIIa CRISPR protein may comprise homopolymeric A or C-RNA.

In certain embodiments, the one or more guide RNAs designed to bind to corresponding target molecules comprise a (synthetic) mismatch. The mismatch may be up- or downstream of a SNP or other single nucleotide variation in said target molecule.

In certain embodiments, the one or more guide RNAs are designed to detect a single nucleotide polymorphism in a target RNA or DNA, or a splice variant of an RNA transcript.

In certain embodiments, the one or more guide RNAs are designed to detect a target molecule or trigger RNA that produce hexadenylates containing a 2'3' cyclic phosphate end when cleaved by the CRISPR RNA-targeting effector protein. The one or more guide RNAs may be designed to detect a target molecule or trigger RNA that comprises a poly A stretch.

In certain embodiments, the one or more guide RNAs are designed to bind to one or more target molecules that are diagnostic for a disease state. The disease state may be cancer. The disease state may be an autoimmune disease. The disease state may be an infection.

In certain embodiments, the infection is caused by a virus, a *bacterium*, a fungus, a protozoan, or a parasite.

In certain embodiments, the infection may be a viral infection. The viral infection may be caused by a DNA virus. The DNA virus may be a Myoviridae, Podoviridae, Siphoviridae, Alloherpesviridae, Herpesviridae (including human herpes virus, and Varicella Zoster virus), Malocoherpesviridae, Lipothrixviridae, Rudiviridae, Adenoviridae, Ampullaviridae, Ascoviridae, Asfarviridae (including African swine fever virus), Baculoviridae, Cicaudaviridae, Clavaviridae, Corticoviridae, Fuselloviridae, Globuloviridae, Guttaviridae, Hytrosaviridae, Iridoviridae, Maseilleviridae, Mimiviridae, Nudiviridae, Nimaviridae, Pandoraviridae, Papillomaviridae, Phycodnaviridae, Plasmaviridae, Polydnaviruses, Polyomaviridae (including Simian virus 40, JC virus, BK virus), Poxviridae (including Cowpox and smallpox), Sphaerolipoviridae, Tectiviridae, Turriviridae, Dinodnavirus, Salterprovirus, Rhizidovirus. The viral infection may be caused by a double-stranded RNA virus, a positive sense RNA virus, a negative sense RNA virus, a retrovirus, or a combination thereof. The viral infection may be caused by a Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus. The viral infection may be caused by Coronavirus, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus.

In certain embodiments, the infection is a bacterial infection. The *bacterium* causing the bacterial infection may be *Acinetobacter* species, *Actinobacillus* species, *Actinomycetes* species, an *Actinomyces* species, *Aerococcus* species an *Aeromonas* species, an *Anaplasma* species, an *Alcaligenes* species, a *Bacillus* species, a *Bacteroides* species, a *Bartonella* species, a *Bifidobacterium* species, a *Bordetella* species, a *Borrelia* species, a *Brucella* species, a *Burkholderia* species, a *Campylobacter* species, a *Capnocytophaga* species, a *Chlamydia* species, a *Citrobacter* species, a *Coxiella* species, a *Corynbacterium* species, a *Clostridium* species, an Eikenella species, an *Enterobacter* species, an *Escherichia* species, an *Enterococcus* species, an *Ehlichia* species, an *Epidermophyton* species, an *Erysipelothrix* species, a *Eubacterium* species, a *Francisella* species, a *Fusobacterium* species, a *Gardnerella* species, a *Gemella* species, a *Haemophilus* species, a *Helicobacter* species, a Kingella species, a *Klebsiella* species, a *Lactobacillus* species, a *Lactococcus* species, a *Listeria* species, a *Leptospira* species, a *Legionella* species, a *Leptospira* species, *Leuconostoc* species, a *Mannheimia* species, a *Microsporum* species, a *Micrococcus* species, a *Moraxella* species, a *Morganell* species, a *Mobiluncus* species, a *Micrococcus* species, *Mycobacterium* species, a *Mycoplasm* species, a *Nocardia* species, a *Neisseria* species, a *Pasteurelaa* species, a *Pediococcus* species, a *Peptostreptococcus* species, a *Pityrosporum* species, a *Plesiomonas* species, a *Prevotella* species, a *Porphyromonas* species, a *Proteus* species, a *Providencia* species, a *Pseudomonas* species, a *Propionibacteriums* species, a *Rhodococcus* species, a *Rickettsia* species, a *Rhodococcus* species, a *Serratia* species, a *Stenotrophomonas* species, a *Salmonella* species, a *Serratia* species, a *Shigella* species, a *Staphylococcus* species, a *Streptococcus* species, a *Spirillum* species, a *Streptobacillus* species, a *Treponema* species, a *Tropheryma* species, a *Trichophyton* species, an *Ureaplasma* species, a *Veillonella* species, a *Vibrio* species, a *Yersinia* species, a *Xanthomonas* species, or combination thereof.

In certain embodiments, the infection is caused by a fungus. The fungus may be *Aspergillus, Blastomyces, Candidiasis, Coccidiodomycosis, Cryptococcus neoformans, Cryptococcus gatti,* sp. *Histoplasma* sp. (such as *Histoplasma capsulatum*), *Pneumocystis* sp. (such as *Pneumocystis jirovecii*), *Stachybotrys* (such as *Stachybotrys chartarum*), *Mucroymcosis, Sporothrix,* fungal eye infections ringworm, *Exserohilum, Cladosporium, Geotrichum, Saccharomyces,* a *Hansenula* species, a *Candida* species, a *Kluyveromyces* species, a *Debaryomyces* species, a *Pichia* species, a *Penicillium* species, a *Cladosporium* species, a *Byssochlamys* species or a combination thereof.

In certain embodiments, the infection is caused by a protozoan. The protozoan may be *Euglenozoa,* a *Heterolobosea,* a *Diplomonadida,* an *Amoebozoa,* a *Blastocystic,* an *Apicomplexa,* or combination thereof.

In certain embodiments, the infection is caused by a parasite. The parasite may be *Trypanosoma cruzi* (Chagas disease), *T. brucei gambiense, T. brucei rhodesiense, Leishmania braziliensis, L. infantum, L. mexicana, L. major, L. tropica, L. donovani, Naegleria fowleri, Giardia intestinalis* (*G. lamblia, G. duodenalis*), *canthamoeba castellanii, Balamuthia madrillaris, Entamoeba histolytica, Blastocystic hominis, Babesia microti, Cryptosporidium parvum, Cyclospora cayetanensis, Plasmodium falciparum, P. vivax, P. ovale, P. malariae,* and *Toxoplasma gondii,* or combination thereof.

In certain embodiments, the reagents to amplify target RNA molecules comprise nucleic acid sequence-based amplification (NASBA), recombinase polymerase amplification (RPA), loop-mediated isothermal amplification (LAMP), strand displacement amplification (SDA), helicase-dependent amplification (HDA), nicking enzyme amplification reaction (NEAR), PCR, multiple displacement amplification (MDA), rolling circle amplification (RCA), ligase chain reaction (LCR), or ramification amplification method (RAM).

In certain embodiments, the system further comprises an enrichment CRISPR system, wherein the enrichment CRISPR system is designed to bind the corresponding target molecules prior to detection by the detection CRISPR system. The enrichment CRISPR system may comprise a catalytically inactive CRISPR effector protein. The catalytically inactive CRISPR effector protein may be a catalytically inactive C2c2. The enrichment CRISPR effector protein may further comprise a tag, wherein the tag is used to pull down the enrichment CRISPR effector system, or to bind the enrichment CRISPR system to a solid substrate. The solid substrate may be a flow cell.

In certain embodiments, the synthetic mismatch in said guide RNA is at position 3, 4, 5, or 6 of the spacer, preferably position 3. The mismatch in said guide RNA may be at position 1, 2, 3, 4, 5, 6, 7, 8, or 9 of the spacer, preferably position 5. The mismatch may be 1, 2, 3, 4, or 5 nucleotides upstream or downstream, preferably 2 nucleotides, preferably downstream of said SNP or other single nucleotide variation in said guide RNA.

In certain embodiments, the guide RNA may comprise a spacer which is truncated relative to a wild type spacer. In certain embodiments, the guide RNA comprises a spacer which comprises less than 28 nucleotides, preferably between and including 20 to 27 nucleotides. The guide RNA may comprise a spacer which consists of 20-25 nucleotides or 20-23 nucleotides, such as preferably 20 or 23 nucleotides.

In certain embodiments, the masking construct comprises an RNA oligonucleotide designed to bind a G-quadruplex forming sequence, wherein a G-quadruplex structure is formed by the G-quadruplex forming sequence upon cleavage of the masking construct, and wherein the G-quadruplex structure generates a detectable positive signal.

In another aspect, the present invention provides for a diagnostic device comprising one or more individual discrete volumes, each individual discrete volume comprising a CRISPR system of any embodiment herein.

In certain embodiments, each individual discrete volume may further comprise one or more detection aptamers comprising a masked RNA polymerase promoter binding site or a masked primer binding site.

In certain embodiments, each individual discrete volume further comprises nucleic acid amplification reagents.

In certain embodiments, the target molecule is a target DNA and the individual discrete volumes further comprise a primer that binds the target DNA and comprises an RNA polymerase promoter.

In certain embodiments, the individual discrete volumes are droplets.

In certain embodiments, the individual discrete volumes are defined on a solid substrate. The individual discrete volumes may be microwells. The individual discrete volumes may be spots defined on a substrate. The substrate may be a flexible materials substrate. The flexible materials substrate may be a paper substrate or a flexible polymer based substrate.

In another aspect, the present invention provides for a method for detecting target nucleic acids in samples, comprising: distributing a sample or set of samples into one or more individual discrete volumes, the individual discrete volumes comprising a CRISPR system as described herein; incubating the sample or set of samples under conditions sufficient to allow binding of the one or more guide RNAs to one or more target molecules; activating the CRISPR effector protein via binding of the one or more guide RNAs to the one or more target molecules, wherein activating the CRISPR effector protein results in modification of the RNA-based masking construct such that a detectable positive signal is generated; and detecting the detectable positive signal, wherein detection of the detectable positive signal indicates a presence of one or more target molecules in the sample.

In another aspect, the present invention provides for a method for detecting polypeptides in samples, comprising: distributing a sample or set of samples into a set of individual discrete volumes, the individual discrete volumes comprising peptide detection aptamers, a CRISPR system as described herein; incubating the sample or set of samples under conditions sufficient to allow binding of the peptide detection aptamers to the one or more target molecules, wherein binding of the aptamer to a corresponding target molecule exposes the RNA polymerase binding site or primer binding site resulting in generation of a trigger RNA; activating the RNA effector protein via binding of the one or more guide RNAs to the trigger RNA, wherein activating the RNA effector protein results in modification of the RNA-based masking construct such that a detectable positive signal is produced; and detecting the detectable positive signal, wherein detection of the detectable positive signal indicates a presence of one or more target molecules in a sample.

In certain embodiments, the target molecule is a target DNA and the method further comprising binding the target DNA with a primer comprising an RNA polymerase site.

In certain embodiments, the method further comprises amplifying the sample RNA or the trigger RNA. Amplifying RNA may comprise amplification by NASBA. Amplifying RNA may comprise amplification by RPA.

In certain embodiments, the sample is a biological sample or an environmental sample. The biological sample may be a blood, plasma, serum, urine, stool, sputum, mucous, lymph fluid, synovial fluid, bile, ascites, pleural effusion, seroma, saliva, cerebrospinal fluid, aqueous or vitreous humor, or any bodily secretion, a transudate, an exudate (for example, fluid obtained from an abscess or any other site of infection or inflammation), or fluid obtained from a joint (for example, a normal joint or a joint affected by disease, such as rheumatoid arthritis, osteoarthritis, gout or septic arthritis), or a swab of skin or mucosal membrane surface. The environmental sample may be obtained from a food sample, paper surface, a fabric, a metal surface, a wood surface, a plastic surface, a soil sample, a fresh water sample, a waste water sample, a saline water sample, or a combination thereof.

In certain embodiments, the one or more guide RNAs are designed to detect a single nucleotide polymorphism in a target RNA or DNA, or a splice variant of an RNA transcript.

In certain embodiments, the one or more guide RNAs are designed to bind to one or more target molecules that are diagnostic for a disease state.

In certain embodiments, the one or more guide RNAs are designed to bind to cell free nucleic acids.

In certain embodiments, the disease state is an infection, an organ disease, a blood disease, an immune system disease, a cancer, a brain and nervous system disease, an endocrine disease, a pregnancy or childbirth-related disease, an inherited disease, or an environmentally-acquired disease. The disease state may be characterized by the presence or absence of an antibiotic or drug resistance or susceptibility gene or transcript or polypeptide, preferably in a pathogen or a cell. The target molecule may be an antibiotic or drug resistance or susceptibility gene or transcript or polypeptide.

In certain embodiments, the method may further comprise comparing the detectable positive signal with a (synthetic) standard signal.

In another aspect, the present invention provides for a method for detecting a target nucleic acid in a sample, comprising: contacting a sample with a nucleic acid detection system as described herein; and applying said contacted sample to a lateral flow immunochromatographic assay. The nucleic acid detection system may comprise an RNA-based masking construct comprising a first and a second molecule, and wherein said lateral flow immunochromatographic assay comprises detecting said first and second molecule, preferably at discrete detection sites on a lateral flow strip. The first molecule and said second molecule may be detected by binding to an antibody recognizing said first or second molecule and detecting said bound molecule, preferably with sandwich antibodies. The lateral flow strip may comprise an upstream first antibody directed against said first molecule, and a downstream second antibody directed against said second molecule, and wherein uncleaved RNA-based masking construct is bound by said first antibody if the target nucleic acid is not present in said sample, and wherein cleaved RNA-based masking construct is bound both by said first antibody and said second antibody if the target nucleic acid is present in said sample.

BRIEF DESCRIPTION OF THE DRAWINGS

FIG. 19—Csm6-enhanced PsmCas13b and LwaCas13a detection for agricultural applications. (A) Csm6-enhanced detection of CP4-EPSPS herbicide resistance gene or Lectin in roundup-ready or WT soybean crude extract with LwaCas13a. (B) Kinetics of Csm6-enhanced detection of CP4-EPSPS herbicide resistance gene or Lectin in roundup-ready or WT soybean crude extract with LwaCas13a.

FIG. 38—Table of Csm6 activators used in the study. Shown are SEQ ID NO: 140 (Csm6 polyA polyU probes for U cutters 5 As), SEQ ID NO: 141 (Csm6 polyA polyU probes for U cutters 6 As), SEQ ID NO: 142 (Csm6 polyA polyU probes for U cutters 7 As), SEQ ID NO: 143 (5' poly U/polyA 6A probe 2,3 cyclic phosphate), and SEQ ID NO: 144 (5'poly A/poly U/polyA 6A probe 2,3 cyclic phosphate). The remaining sequences in this table are shorter than 10 nucleotides and were not assigned sequence identifiers.

FIG. 39—Table of Cas13 and Csm6 proteins purified in the study.

FIG. 40—Table of crRNAs used in the study. Shown are SEQ ID NO:145-519, with SEQ ID NO:145-147 representing the complete crRNA sequence, spacer, and direct repeat, respectively, for ssRNA/ssDNA 1 crRNA2. The remaining sequence identifiers follow the same pattern.

FIG. 41—Table of RNA and DNA targets used in the study. Shown are SEQ ID NO:520-533.

FIG. 42—Table of RPA primers used in the study. Shown are SEQ ID NO:534-563, with SEQ ID NO:534-536 representing the forward primer sequence, the forward primer sequence (with T7 RNAP promoter), and the reverse primer sequence, respectively, for DENV ssRNA. The remaining sequence identifiers follow the same pattern.

FIG. 43—Table of cleavage reporters used in the study. Shown are SEQ ID NO:564 (Lateral flow reporter with FAM/Biotin), SEQ ID NO:565 (RNA motif library for base preference screening), SEQ ID NO:566 (gold nanoparticle linker), SEQ ID NO:567 (magnetic bead conjugate oligo), SEQ ID NO:568 (long poly A for lateral flow), SEQ ID NO:569 (long poly C for lateral flow), and SEQ ID NO:570 (long poly A/C for lateral flow). The remaining sequences listed in this table are shorter than 10 nucleotides and were not assigned sequence identifiers.

DETAILED DESCRIPTION OF THE EXAMPLE EMBODIMENTS

General Definitions

Figure 1:
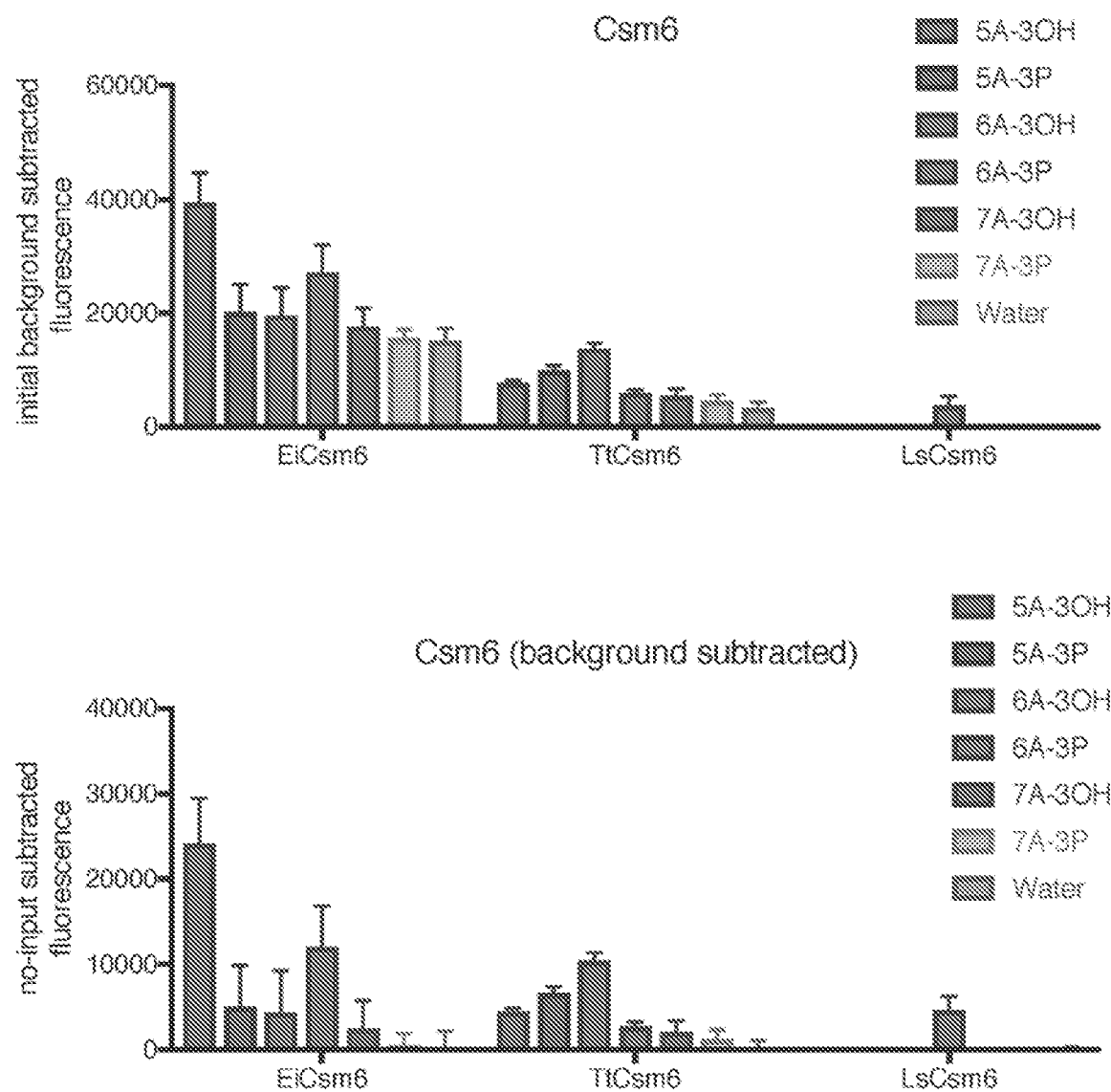
FIG. 1—demonstrates Csm6 activation by poly-A oligos.
Figure 2:
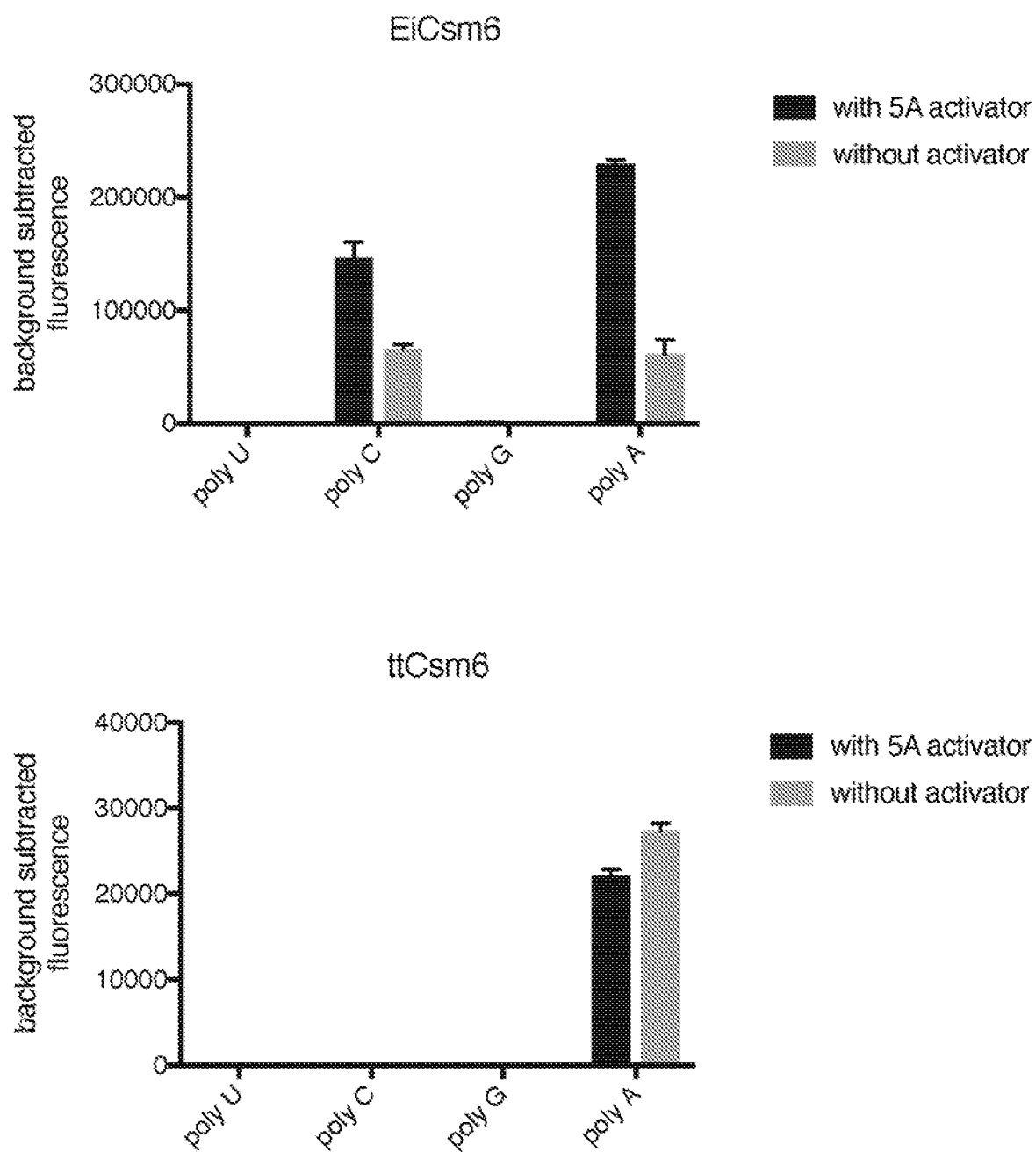
FIG. 2—provides cleavage preference of three Csm6 orthologs. EiCsm6 shows strongest activity with C or A nucleotide preference. LsCsm6 shows activity with A nucleotide preference.
Figure 2:
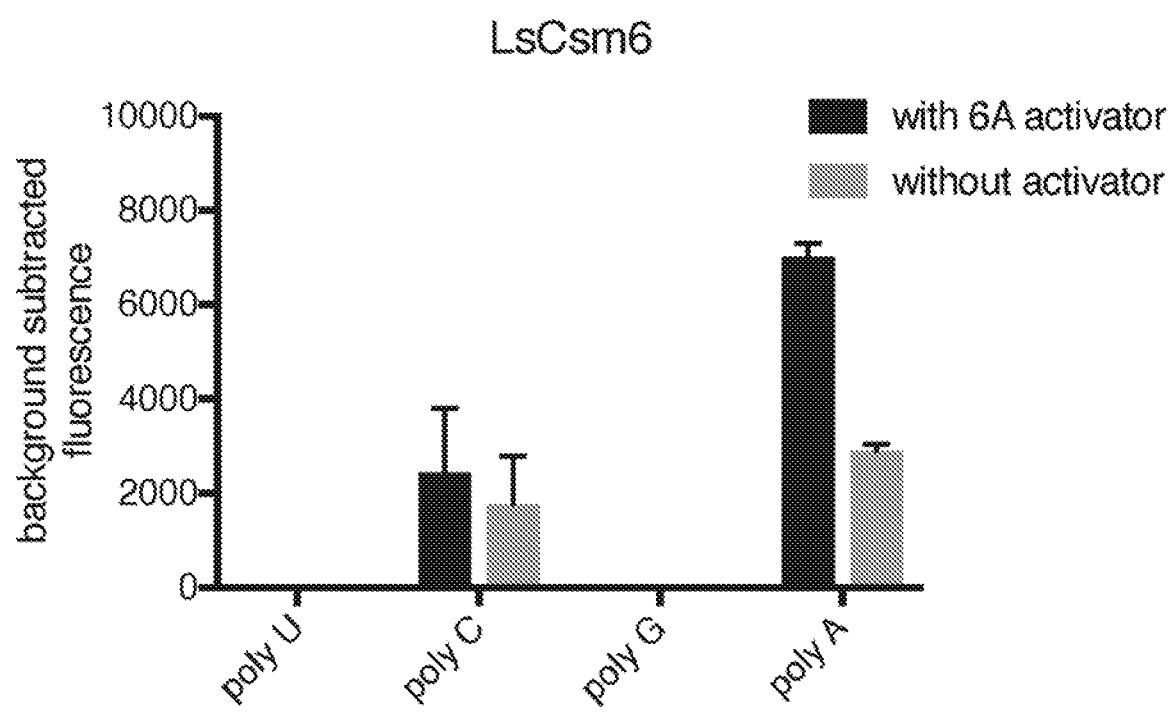
Figure 3:
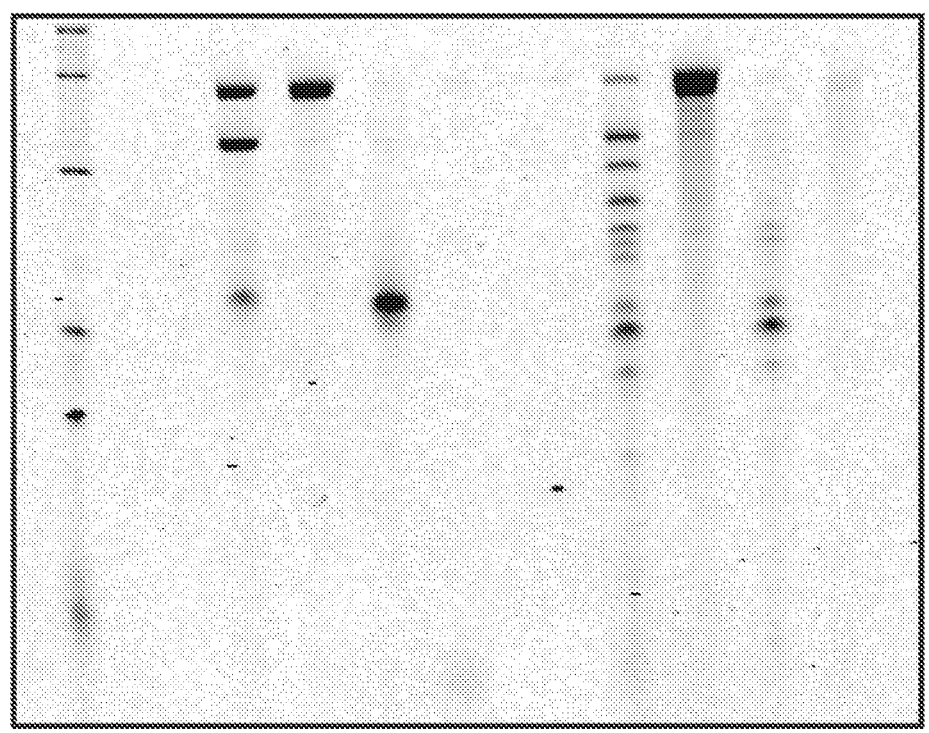
FIG. 3—provides a gel showing cleavage ends of RNAs cleaved by *Prevotella* sp. MA2016 Cas13 ("Cas13b5") and *L. wadei* Cas13a. Without alkaline phosphatase, only fragments that have a 5' hydroxyl can be labeled with dye and show up on gel as seen in lanes 3 and 7.
Figure 4:
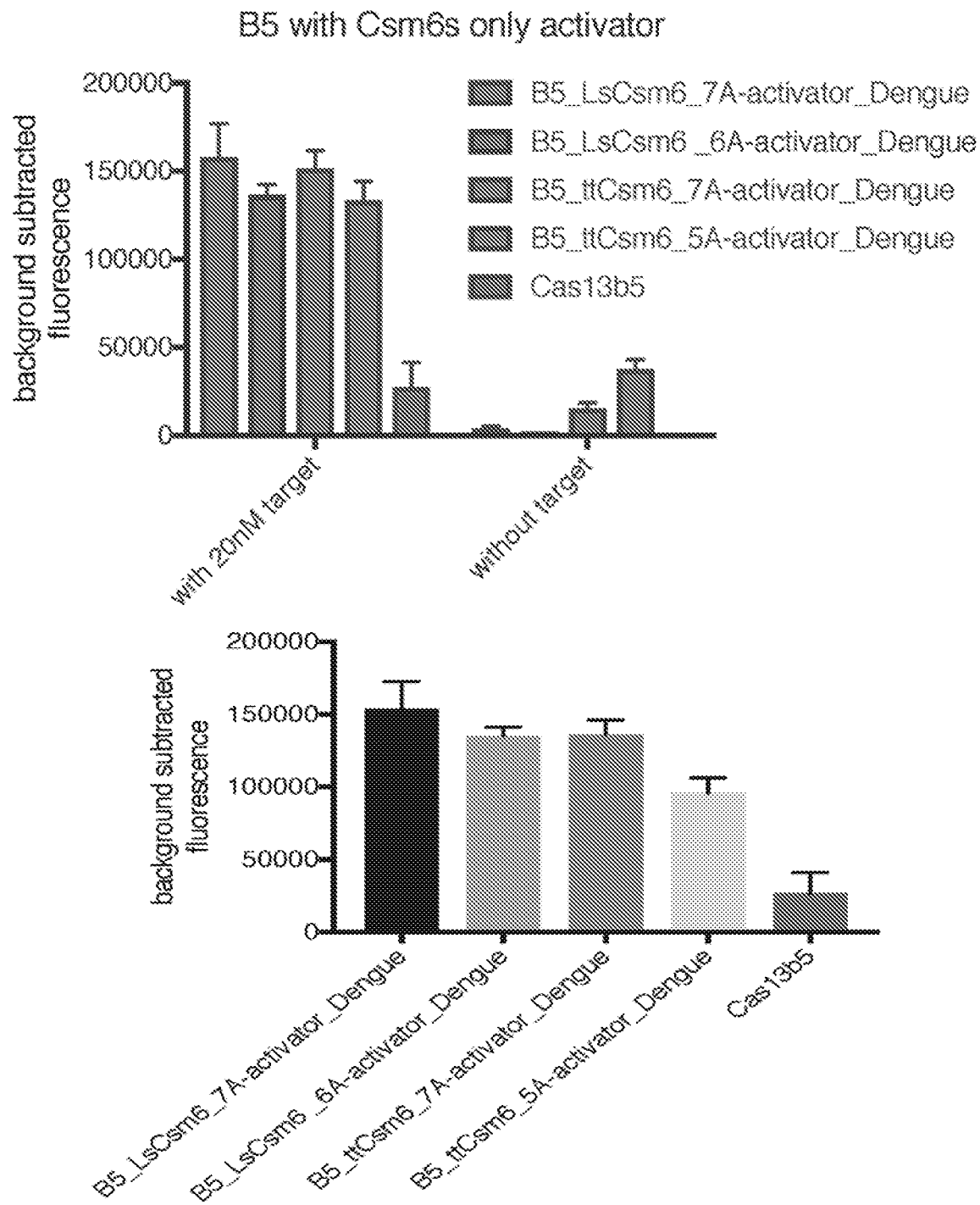
FIG. 4—provides graphs demonstrating Cas13b5 detection of Dengue target is significantly increased by Csm6 positive feedback. Cas13b5 detection of Dengue ssRNA is supplemented with LsCsm6 or ttCsm6 along with poly-A oligos of length 6 or 7 nucleotides. These oligos are cut by Cas13b5 and end up having a 2,3 cyclic phosphate on the 3' end, which is capable of activating Csm6 for cleavage of a FAM-poly-A-quencher reporter construct.

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, $2^{nd}$ edition (1989) (Sambrook, Fritsch, and Maniatis); Molecular Cloning: A Laboratory Manual, $4^{th}$ edition (2012) (Green and Sambrook); Current Protocols in Molecular Biology (1987) (F. M. Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboratory Manual (1988) (Harlow and Lane, eds.): Antibodies A Laboratory Manual, $2^{nd}$ edition 2013 (E. A. Greenfield ed.); Animal Cell Culture (1987) (R. I. Freshney, ed.); Benjamin Lewin, Genes IX, published by Jones and Bartlet, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology 2nd ed., J. Wiley & Sons (New York, N.Y. 1994), March, Advanced Organic Chemistry Reactions, Mechanisms and Structure 4th ed., John Wiley & Sons (New York, N.Y. 1992); and Marten H. Hofker and Jan van Deursen, Transgenic Mouse Methods and Protocols, $2^{nd}$ edition (2011).

As used herein, the singular forms "a", "an", and "the" include both singular and plural referents unless the context clearly dictates otherwise.

The term "optional" or "optionally" means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms "about" or "approximately" as used herein when referring to a measurable value such as a parameter, an amount, a temporal duration, and the like, are meant to encompass variations of and from the specified value, such as variations of +/−10% or less, +/−5% or less, +/−1% or less, and +/−0.1% or less of and from the specified value, insofar such variations are appropriate to perform in the disclosed invention. It is to be understood that the value to which the modifier "about" or "approximately" refers is itself also specifically, and preferably, disclosed.

Reference throughout this specification to "one embodiment", "an embodiment," "an example embodiment," means that a particular feature, structure or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment, but may. Furthermore, the particular features, structures or characteristics may be combined in any suitable manner, as would be apparent to a person skilled in the art from this disclosure, in one or more embodiments. Furthermore, while some embodiments described herein include some but not other features included in other embodiments, combinations of features of different embodiments are meant to be within the scope of the invention. For example, in the appended claims, any of the claimed embodiments can be used in any combination.

All publications, published patent documents, and patent applications cited herein are hereby incorporated by reference to the same extent as though each individual publication, published patent document, or patent application was specifically and individually indicated as being incorporated by reference.

Overview

Embodiments disclosed provide nucleic acid detection compositions, systems, and methods. In certain embodiments, a nucleic acid detection composition comprises at least two CRISPR proteins. In certain example embodiments, the compositions and systems comprise one or more detection proteins and one more signal amplification proteins. The detection protein is activated by binding, with a corresponding guide sequence, to a target sequence, said activation ultimately resulting in generation of a detectable signal. The signal amplification protein is activated through the activity of the detection protein and further amplifies the detectable signal. In certain example embodiments, the nucleic acid detection composition comprises at least one.

In one aspect, the embodiments disclosed herein are directed to a nucleic acid detection composition. The composition comprises at least one CRISPR detection effector protein and at least one CRISPR signal amplification effector protein. In one example embodiment, the CRISPR detection effector protein is a Type VI CRISPR effector protein. In one example embodiment, the Type VI CRISPR effector protein is a Cas13a effector protein. In another example embodiment, the Type VI CRISPR effector protein is a Cas13b effector protein. In certain example embodiments, the CRISPR signal amplification protein is a Type III CRISPR protein. In certain example embodiments, the Type III CRISPR protein is a Csm6 protein. In certain example embodiments, the compositions further comprise one or more guide sequences for the detection CRISPR effector protein, wherein the guide sequence is designed to bind to one or more target sequences. In certain example embodiments, the composition may further comprise an activation sequence that activates the signal amplification CRISPR protein. The activation sequence is distinct from the guide sequence and the target sequence. In certain example embodiments, the activation sequence is a poly-A nucleotide sequence. The poly-A nucleotide sequence may be of variable lengths depending on the type of CRISPR signal amplification effector protein used. In certain example embodiments, the poly-A activation sequence may be 5, 6, 7, 8, 9, 10, 11, 12, 13, 14, 15, 16, 17, 18, 19, 20, 21, 22, 23, 24, or 25 nucleotides in length. In certain example embodiments, the composition comprises both a guide sequence and an activation sequence. In certain example embodiments, the composition may further comprise a reporter construct as described in further detail below.

In certain other aspects, the embodiments disclosed herein are directed to systems comprising at least one detection CRISPR effector protein and at least one signal amplification CRISPR detection protein, one or more guide sequences, one or more guide activation sequences, and one or more reporter constructs. Each of the above elements are described in further detail below.

In certain other aspects, the compositions and systems described herein may be incorporated devices. Suitable device platforms are described in further detail below.

In certain other aspects, the embodiments disclosed herein are directed to methods of detecting target nucleic acid sequences, and/or proteins in certain example embodiments, using the compositions, systems, and devices disclosed herein.

For ease of reference, the embodiments disclosed herein may also be referred to as SHERLOCK (Specific High-sensitivity Enzymatic Reporter unLOCKing).

CRISPR Detection Effector Proteins

In general, a CRISPR-Cas or CRISPR system as used herein and in documents, such as WO 2014/093622 (PCT/US2013/074667), refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). When the CRISPR protein is a C2c2 protein, a tracrRNA is not required. C2c2 has been described in Abudayyeh et al. (2016) "C2c2 is a single-component programmable RNA-guided RNA-targeting CRISPR effector"; Science; DOI: 10.1126/science.aaf5573; and Shmakov et al. (2015) "Discovery and Functional Characterization of Diverse Class 2 CRISPR-Cas Systems", Molecular Cell, DOI: dx.doi.org/10.1016/j.molcel.2015.10.008; which are incorporated herein in their entirety by reference. Cas13b has been described in Smargon et al. (2017) "Cas13b Is a Type VI-B CRISPR-Associated RNA-Guided RNases Differentially Regulated by Accessory Proteins Csx27 and Csx28," Molecular Cell. 65, 1-13; dx.doi.org/10.1016/j.molcel.2016.12.023, which is incorporated herein in its entirety by reference.

In certain embodiments, a protospacer adjacent motif (PAM) or PAM-like motif directs binding of the effector protein complex as disclosed herein to the target locus of interest. In some embodiments, the PAM may be a 5' PAM (i.e., located upstream of the 5' end of the protospacer). In other embodiments, the PAM may be a 3' PAM (i.e., located downstream of the 5' end of the protospacer). The term "PAM" may be used interchangeably with the term "PFS" or "protospacer flanking site" or "protospacer flanking sequence".

In a preferred embodiment, the CRISPR effector protein may recognize a 3' PAM. In certain embodiments, the CRISPR effector protein may recognize a 3' PAM which is 5'H, wherein H is A, C or U. In certain embodiments, the effector protein may be *Leptotrichia shahii* C2c2p, more preferably *Leptotrichia shahii* DSM 19757 C2c2, and the 3' PAM is a 5' H.

In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise RNA polynucleotides. The term "target RNA" refers to an RNA polynucleotide being or comprising the target sequence. In other words, the target RNA may be an RNA polynucleotide or a part of an RNA polynucleotide to which a part of the gRNA, i.e. the guide sequence, is designed to have complementarity and to which the effector function mediated by the complex comprising CRISPR effector protein and a gRNA is to be directed. In some embodiments, a target sequence is located in the nucleus or cytoplasm of a cell.

The nucleic acid molecule encoding a CRISPR effector protein, in particular C2c2, is advantageously a codon optimized CRISPR effector protein. An example of a codon optimized sequence, is in this instance a sequence optimized for expression in eukaryotes, e.g., humans (i.e. being optimized for expression in humans), or for another eukaryote, animal or mammal as herein discussed; see, e.g., SaCas9 human codon optimized sequence in WO 2014/093622 (PCT/US2013/074667). Whilst this is preferred, it will be appreciated that other examples are possible and codon optimization for a host species other than human, or for codon optimization for specific organs is known. In some embodiments, an enzyme coding sequence encoding a CRISPR effector protein is a codon optimized for expression in particular cells, such as eukaryotic cells. The eukaryotic cells may be those of or derived from a particular organism, such as a plant or a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at kazusa.orjp/codon/ and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g. 1, 2, 3, 4, 5, 10, 15, 20, 25, 50, or more, or all codons) in a sequence encoding a Cas correspond to the most frequently used codon for a particular amino acid. The invention is further described in the following examples, which do not limit the scope of the invention described in the claims.

In one example embodiment, the detection effector protein comprises one or more HEPN domains comprising a RxxxxH motif sequence. The RxxxxH motif sequence can be, without limitation, from a HEPN domain described herein or a HEPN domain known in the art. RxxxxH motif sequences further include motif sequences created by combining portions of two or more HEPN domains. As noted, consensus sequences can be derived from the sequences of the orthologs disclosed in U.S. Provisional Patent Application 62/432,240 entitled "Novel CRISPR Enzymes and Systems," U.S. Provisional Patent Application 62/471,710 entitled "Novel Type VI CRISPR Orthologs and Systems" filed on Mar. 15, 2017, and U.S. Provisional Patent Application entitled "Novel Type VI CRISPR Orthologs and Systems," and filed on Apr. 12, 2017.

In an embodiment of the invention, a HEPN domain comprises at least one RxxxxH motif comprising the sequence of R{N/H/K}X1X2X3H (SEQ ID NO:571). In an embodiment of the invention, a HEPN domain comprises a RxxxxH motif comprising the sequence of R{N/H}X1X2X3H (SEQ ID NO:572). In an embodiment of the invention, a HEPN domain comprises the sequence of R{N/K}X1X2X3H (SEQ ID NO:573). In certain embodiments, X1 is R, S, D, E, Q, N, G, Y, or H. In certain embodiments, X2 is I, S, T, V, or L. In certain embodiments, X3 is L, F, N, Y, V, I, S, D, E, or A.

Additional effectors for use according to the invention can be identified by their proximity to cas1 genes, for example, though not limited to, within the region 20 kb from the start of the cas1 gene and 20 kb from the end of the cas1 gene. In certain embodiments, the effector protein comprises at least one HEPN domain and at least 500 amino acids, and wherein the C2c2 effector protein is naturally present in a prokaryotic genome within 20 kb upstream or downstream of a Cas gene or a CRISPR array. Non-limiting examples of Cas proteins include Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologues thereof, or modified versions thereof. In certain example embodiments, the C2c2 effector protein is naturally present in a prokaryotic genome within 20 kb upstream or downstream of a Cas 1 gene. The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of. Homologous proteins may but need not be structurally related, or are only partially structurally related. An "orthologue" of a protein as used herein is a protein of a different species which performs the same or a similar function as the protein it is an orthologue of. Orthologous proteins may but need not be structurally related, or are only partially structurally related.

In particular embodiments, the CRISPR detection effector protein is a Type VI RNA-targeting Cas enzyme. In certain example embodiments, the Type VI RNA-targeting Cas enzyme is Cas 13a, also referred to herein as C2c2. In other example embodiments, the Type VI RNA-targeting Cas enzyme is Cas 13b. In particular embodiments, the homologue or orthologue of a Type VI protein, such as C2c2, has a sequence homology or identity of at least 30%, or at least 40%, or at least 50%, or at least 60%, or at least 70%, or at least 80%, more preferably at least 85%, even more preferably at least 90%, such as for instance at least 95% with a Type VI protein such as C2c2 (e.g., based on the wild-type sequence of any of *Leptotrichia shahii* C2c2, *Lachnospiraceae bacterium* MA2020 C2c2, *Lachnospiraceae bacterium* NK4A179 C2c2, *Clostridium aminophilum* (DSM 10710) C2c2, *Carnobacterium gallinarum* (DSM 4847) C2c2, *Paludibacter propionicigenes* (WB4) C2c2, *Listeria weihenstephanensis* (FSL R9-0317) C2c2, *Listeriaceae bacterium* (FSL M6-0635) C2c2, *Listeria* newyorkensis (FSL M6-0635) C2c2, *Leptotrichia wadei* (F0279) C2c2, *Rhodobacter capsulatus* (SB 1003) C2c2, *Rhodobacter capsulatus* (R121) C2c2, *Rhodobacter capsulatus* (DE442) C2c2, *Leptotrichia wadei* (Lw2) C2c2, or *Listeria seeligeri* C2c2). In further embodiments, the homologue or orthologue of a Type VI protein such as C2c2 as referred to herein has a sequence identity of at least 30%, or at least 40%, or at least 50%, or at least 60%, or at least 70%, or at least 80%, more preferably at least 85%, even more preferably at least 90%, such as for instance at least 95% with the wild type C2c2 (e.g., based on the wild-type sequence of any of *Leptotrichia shahii* C2c2, *Lachnospiraceae bacterium* MA2020 C2c2, *Lachnospiraceae bacterium* NK4A179 C2c2, *Clostridium aminophilum* (DSM 10710) C2c2, *Carnobacterium gallinarum* (DSM 4847) C2c2, *Paludibacter propionicigenes* (WB4) C2c2, *Listeria weihenstephanensis* (FSL R9-0317) C2c2, *Listeriaceae bacterium* (FSL M6-0635) C2c2, *Listeria* newyorkensis (FSL M6-0635) C2c2, *Leptotrichia wadei* (F0279) C2c2, *Rhodobacter capsulatus* (SB 1003) C2c2, *Rhodobacter capsulatus* (R121) C2c2, *Rhodobacter capsulatus* (DE442) C2c2, *Leptotrichia wadei* (Lw2) C2c2, or *Listeria seeligeri* C2c2).

In certain other example embodiments, the CRISPR effector protein is a C2c2 nuclease. The activity of C2c2 may depend on the presence of two HEPN domains. These have been shown to be RNase domains, i.e. nuclease (in particular an endonuclease) cutting RNA. C2c2 HEPN may also target DNA, or potentially DNA and/or RNA. On the basis that the HEPN domains of C2c2 are at least capable of binding to and, in their wild-type form, cutting RNA, then it is preferred that the C2c2 effector protein has RNase function. Regarding C2c2 CRISPR systems, reference is made to U.S. Provisional 62/351,662 filed on Jun. 17, 2016 and U.S. Provisional 62/376,377 filed on Aug. 17, 2016. Reference is also made to U.S. Provisional 62/351,803 filed on Jun. 17, 2016. Reference is also made to U.S. Provisional entitled "Novel Crispr Enzymes and Systems" filed Dec. 8, 2016 bearing Broad Institute No. 10035.PA4. Reference is further made to East-Seletsky et al. "Two distinct RNase activities of CRISPR-C2c2 enable guide-RNA processing and RNA detection" Nature doi: 10/1038/nature19802 and Abudayyeh et al. "C2c2 is a single-component programmable RNA-guided RNA targeting CRISPR effector" bioRxiv doi: 10.1101/054742.

RNase function in CRISPR systems is known, for example mRNA targeting has been reported for certain type III CRISPR-Cas systems (Hale et al., 2014, *Genes Dev*, vol. 28, 2432-2443; Hale et al., 2009, *Cell, vol.* 139, 945-956; Peng et al., 2015, *Nucleic acids research*, vol. 43, 406-417) and provides significant advantages. In the *Staphylococcus epidermis* type III-A system, transcription across targets results in cleavage of the target DNA and its transcripts, mediated by independent active sites within the Cas10-Csm ribonucleoprotein effector protein complex (see, Samai et al., 2015, Cell, vol. 151, 1164-1174). A CRISPR-Cas system, composition or method targeting RNA via the present effector proteins is thus provided.

In an embodiment, the Cas protein may be a C2c2 ortholog of an organism of a genus which includes but is not limited to *Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter*. Species of organism of such a genus can be as otherwise herein discussed.

Some methods of identifying orthologues of CRISPR-Cas system enzymes may involve identifying tracr sequences in genomes of interest. Identification of tracr sequences may relate to the following steps: Search for the direct repeats or tracr mate sequences in a database to identify a CRISPR region comprising a CRISPR enzyme. Search for homologous sequences in the CRISPR region flanking the CRISPR enzyme in both the sense and antisense directions. Look for transcriptional terminators and secondary structures. Identify any sequence that is not a direct repeat or a tracr mate sequence but has more than 50% identity to the direct repeat or tracr mate sequence as a potential tracr sequence. Take the potential tracr sequence and analyze for transcriptional terminator sequences associated therewith.

It will be appreciated that any of the functionalities described herein may be engineered into CRISPR enzymes from other orthologs, including chimeric enzymes comprising fragments from multiple orthologs. Examples of such orthologs are described elsewhere herein. Thus, chimeric enzymes may comprise fragments of CRISPR enzyme orthologs of an organism which includes but is not limited to *Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter*. A chimeric enzyme can comprise a first fragment and a second fragment, and the fragments can be of CRISPR enzyme orthologs of organisms of genera herein mentioned or of species herein mentioned; advantageously the fragments are from CRISPR enzyme orthologs of different species.

In embodiments, the C2c2 protein as referred to herein also encompasses a functional variant of C2c2 or a homologue or an orthologue thereof. A "functional variant" of a protein as used herein refers to a variant of such protein which retains at least partially the activity of that protein. Functional variants may include mutants (which may be insertion, deletion, or replacement mutants), including polymorphs, etc. Also included within functional variants are fusion products of such protein with another, usually unrelated, nucleic acid, protein, polypeptide or peptide. Functional variants may be naturally occurring or may be man-made. Advantageous embodiments can involve engineered or non-naturally occurring Type VI RNA-targeting effector proteins.

In an embodiment, nucleic acid molecule(s) encoding the C2c2 or an ortholog or homolog thereof, may be codon-optimized for expression in a eukaryotic cell. A eukaryote can be as herein discussed. Nucleic acid molecule(s) can be engineered or non-naturally occurring.

In an embodiment, the C2c2 or an ortholog or homolog thereof, may comprise one or more mutations (and hence nucleic acid molecule(s) coding for same may have mutation(s). The mutations may be artificially introduced mutations and may include but are not limited to one or more mutations in a catalytic domain. Examples of catalytic domains with reference to a Cas9 enzyme may include but are not limited to RuvC I, RuvC II, RuvC III and HNH domains.

In an embodiment, the C2c2 or an ortholog or homolog thereof, may comprise one or more mutations. The mutations may be artificially introduced mutations and may include but are not limited to one or more mutations in a catalytic domain. Examples of catalytic domains with reference to a Cas enzyme may include but are not limited to HEPN domains.

In an embodiment, the C2c2 or an ortholog or homolog thereof, may be used as a generic nucleic acid binding protein with fusion to or being operably linked to a functional domain. Exemplary functional domains may include but are not limited to translational initiator, translational activator, translational repressor, nucleases, in particular ribonucleases, a spliceosome, beads, a light inducible/controllable domain or a chemically inducible/controllable domain.

In certain example embodiments, the C2c2 effector protein may be from an organism selected from the group consisting of; *Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma,* and *Campylobacter.*

In certain embodiments, the effector protein may be a *Listeria* sp. C2c2p, preferably *Listeria seeligeria* C2c2p, more preferably *Listeria seeligeria* serovar 1/2b str. SLCC3954 C2c2p and the crRNA sequence may be 44 to 47 nucleotides in length, with a 5' 29-nt direct repeat (DR) and a 15-nt to 18-nt spacer.

In certain embodiments, the effector protein may be a *Leptotrichia* sp. C2c2p, preferably *Leptotrichia shahii* C2c2p, more preferably *Leptotrichia shahii* DSM 19757 C2c2p and the crRNA sequence may be 42 to 58 nucleotides in length, with a 5' direct repeat of at least 24 nt, such as a 5' 24-28-nt direct repeat (DR) and a spacer of at least 14 nt, such as a 14-nt to 28-nt spacer, or a spacer of at least 18 nt, such as 19, 20, 21, 22, or more nt, such as 18-28, 19-28, 20-28, 21-28, or 22-28 nt.

In certain example embodiments, the effector protein may be a *Leptotrichia* sp., *Leptotrichia wadei* F0279, or a *Listeria* sp., preferably *Listeria newyorkensis* FSL M6-0635.

In certain example embodiments, the C2c2 effector proteins of the invention include, without limitation, the following 21 ortholog species (including multiple CRISPR loci: *Leptotrichia shahii; Leptotrichia wadei* (Lw2); *Listeria seeligeri; Lachnospiraceae bacterium* MA2020; *Lachnospiraceae bacterium* NK4A179; [*Clostridium*] *aminophilum* DSM 10710; *Carnobacterium gallinarum* DSM 4847; *Carnobacterium gallinarum* DSM 4847 (second CRISPR Loci); *Paludibacter propionicigenes* WB4; *Listeria weihenstephanensis* FSL R9-0317; *Listeriaceae bacterium* FSL M6-0635; *Leptotrichia wadei* F0279; *Rhodobacter capsulatus* SB 1003; *Rhodobacter capsulatus* R121; *Rhodobacter capsulatus* DE442; *Leptotrichia buccalis* C-1013-b; *Herbinix hemicellulosilytica;* [*Eubacterium*] *rectale; Eubacteriaceae bacterium* CHKCI004; *Blautia* sp. Marseille-P2398; and *Leptotrichia* sp. *oral taxon* 879 str. F0557. Twelve (12) further non-limiting examples are: *Lachnospiraceae bacterium* NK4A144; *Chloroflexus aggregans; Demequina aurantiaca; Thalassospira* sp. TSL5-1; *Pseudobutyrivibrio* sp. OR37; *Butyrivibrio* sp. YAB3001; *Blautia* sp. Marseille-P2398; *Leptotrichia* sp. Marseille-P3007; *Bacteroides ihuae; Porphyromonadaceae bacterium* KH3CP3RA; *Listeria riparia;* and *Insolitispirillum peregrinum.*

In certain embodiments, the C2c2 protein according to the invention is or is derived from one of the orthologues as described in the table below, or is a chimeric protein of two or more of the orthologues as described in the table below, or is a mutant or variant of one of the orthologues as described in the table below (or a chimeric mutant or variant), including dead C2c2, split C2c2, destabilized C2c2, etc. as defined herein elsewhere, with or without fusion with a heterologous/functional domain.

In certain example embodiments, the C2c2 effector protein is selected from Table 1 below.

TABLE 1

| C2c2 orthologue | Code | Multi Letter |
|---|---|---|
| *Leptotrichia shahii* | C2-2 | Lsh |
| *L. wadei* F0279 (Lw2) | C2-3 | Lw2 |
| *Listeria seeligeri* | C2-4 | Lse |
| Lachnospiraceae bacterium MA2020 | C2-5 | LbM |
| Lachnospiraceae bacterium NK4A179 | C2-6 | LbNK179 |
| *Clostridium aminophilum* DSM 10710 | C2-7 | Ca |
| *Carnobacterium gallinarum* DSM 4847 | C2-8 | Cg |
| *Carnobacterium gallinarum* DSM 4847 | C2-9 | Cg2 |
| *Paludibacter propionicigenes* WB4 | C2-10 | Pp |
| *Listeria weihenstephanensis* FSL R9-0317 | C2-11 | Lwei |
| Listeriaceae bacterium FSL M6-0635 | C2-12 | LbFSL |
| *Leptotrichia wadei* F0279 | C2-13 | Lw |
| *Rhodobacter capsulatus* SB 1003 | C2-14 | Rc |
| *Rhodobacter capsulatus* R121 | C2-15 | Rc |
| *Rhodobacter capsulatus* DE442 | C2-16 | Rc |
| *Leptotrichia buccalis* C-1013-b | C2-17 | LbuC2c2 |
| *Herbinix hemicellulosilytics* | C2-18 | HheC2c2 |
| *Eubacterium rectale* | C2-19 | EreC2c2 |
| Eubacteriaceae bacterium CHKCI004 | C2-20 | EbaC2c2 |
| *Blautia* sp. *Marseille*-P2398 | C2-21 | BsmC2c2 |
| *Leptotrichia* sp. oral taxon 879 str. F0557 | C2-22 | LspC2c2 |
| Lachnospiraceae bacterium NK4a144 | | |
| *Chloroflexus aggregans* | | |
| *Demequina aurantiaca* | | |
| *Thalassospira* sp. TSL5-1 | | |
| *Pseudobutyrivibrio* sp. OR37 | | |
| *Butyrivibrio* sp. YAB3001 | | |
| *Blautia* sp. *Marseille*-P2398 | | |
| *Leptotrichia* sp. *Marseille*-P300 | | |
| *Bacteroides ihuae* | | |
| Porphyromonadaceae bacterium KH3CP3RA | | |
| *Listeria riparia* | | |
| *Insolitispirillum peregrinum* | | |

TABLE 2

The wild type protein sequences of the above species are listed in Table 2 below.
In certain embodiments, a nucleic acid sequence encoding the C2c2 protein is provided.

| | |
|---|---|
| C2c2-2 | *L. shahii* (Lsh) (SEQ. I.D. No. 1) |
| c2c2-3 | *L. wadei* (Lw2) (SEQ. I.D. No. 2) |
| c2c2-4 | *Listeria seeligeri* (SEQ. I.D. No. 3) |
| c2c2-5 | 1 Lachnospiraceae bacterium MA2020 (SEQ. I.D. No. 4) |

TABLE 2-continued

The wild type protein sequences of the above species are listed in Table 2 below.
In certain embodiments, a nucleic acid sequence encoding the C2c2 protein is provided.

| | | |
|---|---|---|
| c2c2-6 | 2 | Lachnospiraceae bacterium NK4A179 (SEQ. I.D. No. 5) |
| c2c2-7 | 3 | *Clostridium aminophilum* DSM 10710 (SEQ. I.D. No. 6) |
| c2c2-8 | 5 | *Carnobacterium gallinarum* DSM 4847 (SEQ. I.D. No. 7) |
| c2c2-9 | 6 | *Carnobacterium gallinarum* DSM 4847 (SEQ. I.D. No. 8) |
| c2c2-10 | 7 | *Paludibacter propionicigenes* WB4 (SEQ. I.D. No. 9) |
| c2c2-11 | 9 | *Listeria weihenstephanensis* FSL R9-0317 (SEQ. I.D. No. 10) |
| c2c2-12 | 10 | Listeriaceae bacterium FSL M6-0635 = *Listeria newyorkensis* FSL M6-0635 (SEQ. I.D. No. 11) |
| c2c2-13 | 12 | *Leptotrichia wadei* F0279 (SEQ. I.D. No. 12) |
| c2c2-14 | 15 | *Rhodobacter capsulatus* SB 1003 (SEQ. I.D. No. 13) |
| c2c2-15 | 16 | *Rhodobacter capsulatus* R121 (SEQ. I.D. No. 14) |
| c2c2-16 | 17 | *Rhodobacter capsulatus* DE442 (SEQ. I.D. No. 15) |
| LbuC2c2 | | *Leptorichia buccalis* C-1013-b (SEQ ID NO: 16) |
| HheC2c2 | | *Herbinix hemicellulosilytica* (SEQ ID NO: 17) |
| EreC2c2 | | *Eubacterium rectale* (SEQ ID NO: 18) |
| EbaC2C2 | | Eubacteriaceae bacterium CHKCI004 (SEQ ID NO: 19) |
| C2c2 NK4A144 | | Lachnospiraceae bacterium NK4A144 (SEQ ID NO: 20) |
| C2c2 Chloro_agg | | RNA-binding protein S1 *Chloroflexus aggregans* (SEQ ID NO: 21) |
| C2c2 Dem_Aur | | *Demequina aurantiaca* (SEQ ID NO: 22) |
| C2c2 Thal_Sp_TSL5 | | *Thalassospira* sp. TSL5-1 (SEQ ID NO: 23) |
| C2c2 Pseudo_sp | | *Pseudobutyrivibrio* sp. OR37 (SEQ ID NO: 24) |
| C2c2_Buty_sp | | *Butyrivibrio* sp. YAB3001 (SEQ ID NO: 25) |
| C2c2_Blautia_sp | | *Blautia* sp. *Marseille*-P2398 (SEQ ID NO: 26) |
| C2c2_Lepto_sp_Marseille | | *Leptotrichia* sp. *Marseille*-P3007 (SEQ ID NO: 27) |
| C2c2_Bacteroides_ihuae | | *Bacteroides ihuae* (SEQ ID NO: 28) |
| C2c2_Porph_bacterium | | Porphyromonadaceae bacterium KH3CP3RA (SEQ ID NO: 29) |
| C2c2_Listeria_riparia | | *Listeria riparia* (SEQ ID NO: 30) |
| C2c2_insolitis_peregrinum | | *Insolitispirillum peregrinum* (SEQ ID NO: 31) |

In an embodiment of the invention, there is provided an effector protein which comprises an amino acid sequence having at least 80% sequence homology to the wild-type sequence of any of Leptotrichia shahii C2c2, Lachnospiraceae bacterium MA2020 C2c2, Lachnospiraceae bacterium NK4A179 C2c2, Clostridium aminophilum (DSM 10710) C2c2, Carnobacterium gallinarum (DSM 4847) C2c2, Paludibacter propionicigenes (WB4) C2c2, Listeria weihenstephanensis (FSL R9-0317) C2c2, Listeriaceae bacterium (FSL M6-0635) C2c2, Listeria newyorkensis (FSL M6-0635) C2c2, Leptotrichia wadei (F0279) C2c2, Rhodobacter capsulatus (SB 1003) C2c2, Rhodobacter capsulatus (R121) C2c2, Rhodobacter capsulatus (DE442) C2c2, Leptotrichia wadei (Lw2) C2c2, or Listeria seeligeri C2c2.

In an embodiment of the invention, the effector protein comprises an amino acid sequence having at least 80% sequence homology to a Type VI effector protein consensus sequence including but not limited to a consensus sequence described herein. According to the invention, a consensus sequence can be generated from multiple C2c2 orthologs, which can assist in locating conserved amino acid residues, and motifs, including but not limited to catalytic residues and HEPN motifs in C2c2 orthologs that mediate C2c2 function. One such consensus sequence, generated from the 33 orthologs mentioned above using Geneious alignment is SEQ ID NO: 32.

In another non-limiting example, a sequence alignment tool to assist generation of a consensus sequence and identification of conserved residues is the MUSCLE alignment tool (www.ebi.ac.uk/Tools/msa/muscle/). For example, using MUSCLE, the following amino acid locations conserved among C2c2 orthologs can be identified in *Leptotrichia wadei* C2c2:K2; K5; V6; E301; L331; 1335; N341; G351; K352; E375; L392; L396; D403; F446; 1466; 1470; R474 (HEPN); H475; H479 (HEPN), E508; P556; L561; 1595; Y596; F600; Y669; 1673; F681; L685; Y761; L676; L779; Y782; L836; D847; Y863; L869; 1872; K879; 1933; L954; 1958; R961; Y965; E970; R971; D972; R1046 (HEPN), H1051 (HEPN), Y1075; D1076; K1078; K1080; 11083; 11090.

In certain example embodiments, the RNA-targeting effector protein is a Type VI-B effector protein, such as Cas13b and Group 29 or Group 30 proteins. In certain example embodiments, the RNA-targeting effector protein comprises one or more HEPN domains. In certain example embodiments, the RNA-targeting effector protein comprises a C-terminal HEPN domain, an N-terminal HEPN domain, or both. Regarding example Type VI-B effector proteins that may be used in the context of this invention, reference is made to U.S. application Ser. No. 15/331,792 entitled "Novel CRISPR Enzymes and Systems" and filed Oct. 21, 2016, International Patent Application No. PCT/US2016/058302 entitled "Novel CRISPR Enzymes and Systems", and filed Oct. 21, 2016, and Smargon et al. "Cas13b is a Type VI-B CRISPR-associated RNA-Guided RNase differentially regulated by accessory proteins Csx27 and Csx28" Molecular Cell, 65, 1-13 (2017); dx.doi.org/10.1016/j.molcel.2016.12.023, and U.S. Provisional Application No. to be assigned, entitled "Novel Cas13b Orthologues CRISPR Enzymes and System" filed Mar. 15, 2017. In particular embodiments, the Cas13b enzyme is derived from *Bergeyella* zoohelcum. In certain other example embodiments, the detection effector protein is, or comprises an amino acid sequence having at least 80% sequence homology to any of the sequences listed in Table 3.

TABLE 3

| | |
|---|---|
| *Bergeyella zoohelcum* | 1 (SEQ ID NO: 33) |
| *Prevotella intermedia* | 2 (SEQ ID NO: 34) |
| *Prevotella buccae* | 3 (SEQ ID NO: 35) |
| *Porphyromonas gingivalis* | 4 (SEQ ID NO: 36) |
| *Bacteroides pyogenes* | 5 (SEQ ID NO: 37) |
| *Alistipes* sp. ZOR0009 | 6 (SEQ ID NO: 38) |
| *Prevotella* sp. MA2016 | 7a (SEQ ID NO: 39) |
| *Prevotella* sp. MA2016 | 7b (SEQ ID NO: 40) |
| *Riemerella anatipestifer* | 8 (SEQ ID NO: 41) |
| *Prevotella aurantiaca* | 9 (SEQ ID NO: 42) |
| *Prevotella saccharolytica* | 10 (SEQ ID NO: 43) |
| HMPREF9712_03108 [*Myroides odoratimimus* CCUG 10230] | 11 (SEQ ID NO: 44) |
| *Prevotella intermedia* | 12 (SEQ ID NO: 45) |
| *Capnocytophaga canimorsus* | 13 (SEQ ID NO: 46) |
| *Porphyromonas gulae* | 14 (SEQ ID NO: 47) |
| *Prevotella* sp. P5-125 | 15 (SEQ ID NO: 48) |
| *Flavobacterium branchiophilum* | 16 (SEQ ID NO: 49) |
| *Myroides odoratimimus* | 17 (SEQ ID NO: 50) |
| *Flavobacterium columnare* | 18 (SEQ ID NO: 51) |
| *Porphyromonas gingivalis* | 19 (SEQ ID NO: 52) |
| *Porphyromonas* sp. COT-052 OH4946 | 20 (SEQ ID NO: 53) |
| *Prevotella intermedia* | 21 (SEQ ID NO: 54) |
| PIN17_0200 [*Prevotella intermedia* 17] | AFJ07523 (SEQ ID NO: 55) |
| *Prevotella intermedia* | BAU18623 (SEQ ID NO: 56) |
| HMPREF6485_0083 [*Prevotella buccae* ATCC 33574] | EFU31981 (SEQ ID NO: 57) |
| HMPREF9144_1146 [*Prevotella pallens* ATCC 700821] | EGQ18444 (SEQ ID NO: 58) |
| HMPREF9714_02132 [*Myroides odoratimimus* CCUG 12901] | EHO08761 (SEQ ID NO: 59) |
| HMPREF9711_00870 [*Myroides odoratimimus* CCUG 3837] | EKB06014 (SEQ ID NO: 60) |
| HMPREF9699_02005 [*Bergeyella zoohelcum* ATCC 43767] | EKB54193 (SEQ ID NO: 61) |
| HMPREF9151_01387 [*Prevotella saccharolytica* F0055] | EKY00089 (SEQ ID NO: 62) |
| A343_1752 [*Porphyromonas gingivalis* JCVI SC001] | EOA10535 (SEQ ID NO: 63) |
| HMPREF1981_03090 [*Bacteroides pyogenes* F0041] | ERI81700 (SEQ ID NO: 64) |
| HMPREF1553_02065 [*Porphyromonas gingivalis* F0568] | ERJ65637 (SEQ ID NO: 65) |
| HMPREF1988_01768 [*Porphyromonas gingivalis* F0185] | ERJ81987 (SEQ ID NO: 66) |
| HMPREF1990_01800 [*Porphyromonas gingivalis* W4087] | ERJ87335 (SEQ ID NO: 67) |
| M573_117042 [*Prevotella intermedia* ZT] | KJJ86756 (SEQ ID NO: 68) |
| A2033_10205 [*Bacteroidetes bacterium* GWA2_31_9] | OFX18020.1 (SEQ ID NO: 69) |
| SAMN05421542_0666 [*Chryseobacterium jejuense*] | SDI27289.1 (SEQ ID NO: 70) |
| SAMN05444360_11366 [*Chryseobacterium carnipullorum*] | SHM52812.1 (SEQ ID NO: 71) |
| SAMN05421786_1011119 [*Chryseobacterium ureilyticum*] | SIS70481.1 (SEQ ID NO: 72) |
| *Prevotella buccae* | WP_004343581 (SEQ ID NO: 73) |
| *Porphyromonas gingivalis* | WP_005873511 (SEQ ID NO: 74) |
| *Porphyromonas gingivalis* | WP_005874195 (SEQ ID NO: 75) |
| *Prevotella pallens* | WP_006044833 (SEQ ID NO: 76) |
| *Myroides odoratimimus* | WP_006261414 (SEQ ID NO: 77) |
| *Myroides odoratimimus* | WP_006265509 (SEQ ID NO: 78) |
| *Prevotella* sp. MSX73 | WP_007412163 (SEQ ID NO: 79) |
| *Porphyromonas gingivalis* | WP_012458414 (SEQ ID NO: 80) |
| *Paludibacter propionicigenes* | WP_013446107 (SEQ ID NO: 81) |
| *Porphyromonas gingivalis* | WP_013816155 (SEQ ID NO: 82) |
| *Flavobacterium columnare* | WP_014165541 (SEQ ID NO: 83) |
| *Psychroflexus torquis* | WP_015024765 (SEQ ID NO: 84) |
| *Riemerella anatipestifer* | WP_015345620 (SEQ ID NO: 85) |
| *Prevotella pleuritidis* | WP_021584635 (SEQ ID NO: 86) |
| *Porphyromonas gingivalis* | WP_021663197 (SEQ ID NO: 87) |
| *Porphyromonas gingivalis* | WP_021665475 (SEQ ID NO: 88) |
| *Porphyromonas gingivalis* | WP_021677657 (SEQ ID NO: 89) |
| *Porphyromonas gingivalis* | WP_021680012 (SEQ ID NO: 90) |
| *Porphyromonas gingivalis* | WP_023846767 (SEQ ID NO: 91) |
| *Prevotella falsenii* | WP_036884929 (SEQ ID NO: 92) |
| *Prevotella pleuritidis* | WP_036931485 (SEQ ID NO: 93) |
| [*Porphyromonas gingivalis* | WP_039417390 (SEQ ID NO: 94) |
| *Porphyromonas gulae* | WP_039418912 (SEQ ID NO: 95) |
| *Porphyromonas gulae* | WP_039419792 (SEQ ID NO: 96) |

TABLE 3-continued

| | |
|---|---|
| *Porphyromonas gulae* | WP_039426176 (SEQ ID NO: 97) |
| *Porphyromonas gulae* | WP_039431778 (SEQ ID NO: 98) |
| *Porphyromonas gulae* | WP_039437199 (SEQ ID NO: 99) |
| *Porphyromonas gulae* | WP_039442171 (SEQ ID NO: 100) |
| *Porphyromonas gulae* | WP_039445055 (SEQ ID NO: 101) |
| *Capnocytophaga cynodegmi* | WP_041989581 (SEQ ID NO: 102) |
| *Prevotella* sp. P5-119 | WP_042518169 (SEQ ID NO: 103) |
| *Prevotella* sp. P4-76 | WP_044072147 (SEQ ID NO: 104) |
| *Prevotella* sp. P5-60 | WP_044074780 (SEQ ID NO: 105) |
| *Phaeodactylibacter xiamenensis* | WP_044218239 (SEQ ID NO: 106) |
| *Flavobacterium* sp. 316 | WP_045968377 (SEQ ID NO: 107) |
| *Porphyromonas gulae* | WP_046201018 (SEQ ID NO: 108) |
| WP_047431796 | *Chryseobacterium* sp. YR477 (SEQ ID NO: 109) |
| *Riemerella anatipestifer* | WP_049354263 (SEQ ID NO: 110) |
| *Porphyromonas gingivalis* | WP_052912312 (SEQ ID NO: 111) |
| *Porphyromonas gingivalis* | WP_058019250 (SEQ ID NO: 112) |
| *Flavobacterium columnare* | WP_060381855 (SEQ ID NO: 113) |
| *Porphyromonas gingivalis* | WP_061156470 (SEQ ID NO: 114) |
| *Porphyromonas gingivalis* | WP_061156637 (SEQ ID NO: 115) |
| *Riemerella anatipestifer* | WP_061710138 (SEQ ID NO: 116) |
| *Flavobacterium columnare* | WP_063744070 (SEQ ID NO: 117) |
| *Riemerella anatipestifer* | WP_064970887 (SEQ ID NO: 118) |
| *Sinomicrobium oceani* | WP_072319476.1 (SEQ ID NO: 119) |
| *Reichenbachiella agariperforans* | WP_073124441.1 (SEQ ID NO: 120) |

Guide Sequences

As used herein, the term "crRNA" or "guide RNA" or "single guide RNA," "gRNA" refers to a polynucleotide comprising any polynucleotide sequence having sufficient complementarity with a target nucleic acid sequence to hybridize with the target nucleic acid sequence and to direct sequence-specific binding of an RNA-targeting complex comprising the gRNA and a CRISPR effector protein to the target nucleic acid sequence. In general, a gRNA may be any polynucleotide sequence (i) being able to form a complex with a CRISPR effector protein and (ii) comprising a sequence having sufficient complementarity with a target polynucleotide sequence to hybridize with the target sequence and direct sequence-specific binding of a CRISPR complex to the target sequence. As used herein the term "capable of forming a complex with the CRISPR effector protein" refers to the gRNA having a structure that allows specific binding by the CRISPR effector protein to the gRNA such that a complex is formed that is capable of binding to a target RNA in a sequence specific manner and that can exert a function on said target RNA. Structural components of the gRNA may include direct repeats and a guide sequence (or spacer). The sequence specific binding to the target RNA is mediated by a part of the gRNA, the "guide sequence", being complementary to the target RNA. In embodiments of the invention the term guide RNA, i.e. RNA capable of guiding Cas to a target locus, is used as in foregoing cited documents such as WO 2014/093622 (PCT/US2013/074667). As used herein the term "wherein the guide sequence is capable of hybridizing" refers to a subsection of the gRNA having sufficient complementarity to the target sequence to hybridize thereto and to mediate binding of a CRISPR complex to the target RNA. In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting examples of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies; available at novocraft.com), ELAND (Illumina, San Diego, CA), SOAP (available at soap.genomics.org.cn), and Maq (available at maq. sourceforge.net).

In certain embodiments, the CRISPR system as provided herein can make use of a crRNA or analogous polynucleotide comprising a guide sequence, wherein the polynucleotide is an RNA, a DNA or a mixture of RNA and DNA, and/or wherein the polynucleotide comprises one or more nucleotide analogs. The sequence can comprise any structure, including but not limited to a structure of a native crRNA, such as a bulge, a hairpin or a stem loop structure. In certain embodiments, the polynucleotide comprising the guide sequence forms a duplex with a second polynucleotide sequence which can be an RNA or a DNA sequence.

In certain embodiments, use is made of chemically modified guide RNAs. Examples of guide RNA chemical modifications include, without limitation, incorporation of 2'-O-methyl (M), 2'-O-methyl 3'phosphorothioate (MS), or 2'-O-methyl 3'thioPACE (MSP) at one or more terminal nucleotides. Such chemically modified guide RNAs can comprise increased stability and increased activity as compared to unmodified guide RNAs, though on-target vs. off-target specificity is not predictable. (See, Hendel, 2015, Nat Biotechnol. 33(9):985-9, doi: 10.1038/nbt.3290, published online 29 Jun. 2015). Chemically modified guide RNAs further include, without limitation, RNAs with phosphorothioate linkages and locked nucleic acid (LNA) nucleotides comprising a methylene bridge between the 2' and 4' carbons of the ribose ring.

In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10 to 30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay. Similarly, cleavage of a target RNA may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

A guide sequence, and hence a nucleic acid-targeting guide RNA may be selected to target any target nucleic acid sequence. In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise RNA polynucleotides. The term "target RNA" refers to an RNA polynucleotide being or comprising the target sequence. In other words, the target RNA may be an RNA polynucleotide or a part of an RNA polynucleotide to which a part of the gRNA, i.e. the guide sequence, is designed to have complementarity and to which the effector function mediated by the complex comprising CRISPR effector protein and a gRNA is to be directed. In some embodiments, a target sequence is located in the nucleus or cytoplasm of a cell. The target sequence may be DNA. The target sequence may be any RNA sequence. In some embodiments, the target sequence may be a sequence within an RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nuclear RNA (snoRNA), double stranded RNA (dsRNA), non coding RNA (ncRNA), long non-coding RNA (lncRNA), and small cytoplasmic RNA (scRNA). In some preferred embodiments, the target sequence may be a sequence within an RNA molecule selected from the group consisting of mRNA, pre-mRNA, and rRNA. In some preferred embodiments, the target sequence may be a sequence within an RNA molecule selected from the group consisting of ncRNA, and lncRNA. In some more preferred embodiments, the target sequence may be a sequence within an mRNA molecule or a pre-mRNA molecule.

In some embodiments, a nucleic acid-targeting guide RNA is selected to reduce the degree of secondary structure within the RNA-targeting guide RNA. In some embodiments, about or less than about 75%, 50%, 40%, 30%, 25%, 20%, 15%, 10%, 5%, 1%, or fewer of the nucleotides of the nucleic acid-targeting guide RNA participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A.R. Gruber et al., 2008, Cell 106(1): 23-24; and PA Carr and GM Church, 2009, Nature Biotechnology 27(12): 1151-62).

In certain embodiments, a guide RNA or crRNA may comprise, consist essentially of, or consist of a direct repeat (DR) sequence and a guide sequence or spacer sequence. In certain embodiments, the guide RNA or crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence.

In certain embodiments, the crRNA comprises a stem loop, preferably a single stem loop. In certain embodiments, the direct repeat sequence forms a stem loop, preferably a single stem loop.

In certain embodiments, the spacer length of the guide RNA is from 15 to 35 nt. In certain embodiments, the spacer length of the guide RNA is at least 15 nucleotides, preferably at least 18 nt, such as at least 19, 20, 21, 22, or more nt. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer.

In certain embodiments, the spacer length of the guide RNA is less than 28 nucleotides. In certain embodiments, the spacer length of the guide RNA is at least 18 nucleotides and less than 28 nucleotides. In certain embodiments, the spacer length of the guide RNA is between 19 and 28 nucleotides. In certain embodiments, the spacer length of the guide RNA is between 19 and 25 nucleotides. In certain embodiments, the spacer length of the guide RNA is 20 nucleotides. In certain embodiments, the spacer length of the guide RNA is 23 nucleotides. In certain embodiments, the spacer length of the guide RNA is 25 nucleotides.

In a classic CRISPR-Cas systems, the degree of complementarity between a guide sequence and its corresponding target sequence can be about or more than about 50%, 60%, 75%, 80%, 85%, 90%, 95%, 97.5%, 99%, or 100%; a guide or RNA or sgRNA can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length; or guide or RNA or sgRNA can be less than about 75, 50, 45, 40, 35, 30, 25, 20, 15, 12, or fewer nucleotides in length. However, an aspect of the invention is to reduce off-target interactions, e.g., reduce the guide interacting with a target sequence having low complementarity. Indeed, in the examples, it is shown that the invention involves mutations that result in the CRISPR-Cas system being able to distinguish between target and off-target sequences that have greater than 80% to about 95% complementarity, e.g., 83%-84% or 88-89% or 94-95% complementarity (for instance, distinguishing between a target having 18 nucleotides from an off-target of 18 nucleotides having 1, 2 or 3 mismatches). Accordingly, in the context of the present invention the degree of complementarity between a guide sequence and its corresponding target sequence is greater than 94.5% or 95% or 95.5% or 96% or 96.5% or 97% or 97.5% or 98% or 98.5% or 99% or 99.5% or 99.9%, or 100%. Off target is less than 100% or 99.9% or 99.5% or 99% or 99% or 98.5% or 98% or 97.5% or 97% or 96.5% or 96% or 95.5% or 95% or 94.5% or 94% or 93% or 92% or 91% or 90% or 89% or 88% or 87% or 86% or 85% or 84% or 83% or 82% or 81% or 80% complementarity between the sequence and the guide, with it advantageous that off target is 100% or 99.9% or 99.5% or 99% or 99% or 98.5% or 98% or 97.5% or 97% or 96.5% or 96% or 95.5% or 95% or 94.5% complementarity between the sequence and the guide.

In certain embodiments, modulations of cleavage efficiency can be exploited by introduction of mismatches, e.g. 1 or more mismatches, such as 1 or 2 mismatches between spacer sequence and target sequence, including the position of the mismatch along the spacer/target. The more central (i.e. not 3' or 5') for instance a double mismatch is, the more cleavage efficiency is affected. Accordingly, by choosing a mismatch position along the spacer, cleavage efficiency can be modulated. By means of example, if less than 100% cleavage of targets is desired (e.g. in a cell population), 1 or more, such as preferably 2 mismatches between spacer and target sequence may be introduced in the spacer sequences. The more central along the spacer of the mismatch position, the lower the cleavage percentage.

In certain example embodiments, the cleavage efficiency may be exploited to design single guides that can distinguish two or more targets that vary by a single nucleotide, such as a single nucleotide polymorphism (SNP), variation, or (point) mutation. The CRISPR effector may have reduced sensitivity to SNPs (or other single nucleotide variations) and continue to cleave SNP targets with a certain level of efficiency. Thus, for two targets, or a set of targets, a guide RNA may be designed with a nucleotide sequence that is complementary to one of the targets i.e. the on-target SNP. The guide RNA is further designed to have a synthetic mismatch. As used herein a "synthetic mismatch" refers to a non-naturally occurring mismatch that is introduced upstream or downstream of the naturally occurring SNP, such as at most 5 nucleotides upstream or downstream, for instance 4, 3, 2, or 1 nucleotide upstream or downstream, preferably at most 3 nucleotides upstream or downstream, more preferably at most 2 nucleotides upstream or downstream, most preferably 1 nucleotide upstream or downstream (i.e. adjacent the SNP). When the CRISPR effector binds to the on-target SNP, only a single mismatch will be formed with the synthetic mismatch and the CRISPR effector will continue to be activated and a detectable signal will be produced. When the guide RNA hybridizes to an off-target SNP, two mismatches will be formed, the mismatch from the SNP and the synthetic mismatch, and no detectable signal will be generated. Thus, the systems disclosed herein may be designed to distinguish SNPs within a population. For example, the systems may be used to distinguish pathogenic strains that differ by a single SNP or detect certain disease specific SNPs, such as but not limited to, disease associated SNPs, such as without limitation cancer associated SNPs.

In certain embodiments, the guide RNA is designed such that the SNP is located on position 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the spacer sequence (starting at the 5' end). In certain embodiments, the guide RNA is designed such that the SNP is located on position 1, 2, 3, 4, 5, 6, 7, 8, or 9 of the spacer sequence (starting at the 5' end). In certain embodiments, the guide RNA is designed such that the SNP is located on position 2, 3, 4, 5, 6, or 7 of the spacer sequence (starting at the 5' end). In certain embodiments, the guide RNA is designed such that the SNP is located on position 3, 4, 5, or 6 of the spacer sequence (starting at the 5' end). In certain embodiments, the guide RNA is designed such that the SNP is located on position 3 of the spacer sequence (starting at the 5' end).

In certain embodiments, the guide RNA is designed such that the mismatch (e.g. the synthetic mismatch, i.e. an additional mutation besides a SNP) is located on position 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the spacer sequence (starting at the 5' end). In certain embodiments, the guide RNA is designed such that the mismatch is located on position 1, 2, 3, 4, 5, 6, 7, 8, or 9 of the spacer sequence (starting at the 5' end). In certain embodiments, the guide RNA is designed such that the mismatch is located on position 4, 5, 6, or 7 of the spacer sequence (starting at the 5' end). In certain embodiments, the guide RNA is designed such that the mismatch is located on position 5 of the spacer sequence (starting at the 5' end).

In certain embodiments, the guide RNA is designed such that the mismatch is located 2 nucleotides upstream of the SNP (i.e. one intervening nucleotide).

In certain embodiments, the guide RNA is designed such that the mismatch is located 2 nucleotides downstream of the SNP (i.e. one intervening nucleotide).

In certain embodiments, the guide RNA is designed such that the mismatch is located on position 5 of the spacer sequence (starting at the 5' end) and the SNP is located on position 3 of the spacer sequence (starting at the 5' end).

The embodiments described herein comprehend inducing one or more nucleotide modifications in a eukaryotic cell (in vitro, i.e. in an isolated eukaryotic cell) as herein discussed comprising delivering to cell a vector as herein discussed. The mutation(s) can include the introduction, deletion, or substitution of one or more nucleotides at each target sequence of cell(s) via the guide(s) RNA(s). The mutations can include the introduction, deletion, or substitution of 1-75 nucleotides at each target sequence of said cell(s) via the guide(s) RNA(s). The mutations can include the introduction, deletion, or substitution of 1, 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations include the introduction, deletion, or substitution of 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 40, 45, 50, 75, 100, 200, 300, 400 or 500 nucleotides at each target sequence of said cell(s) via the guide(s) RNA(s).

Typically, in the context of an endogenous CRISPR system, formation of a CRISPR complex (comprising a guide sequence hybridized to a target sequence and complexed with one or more Cas proteins) results in cleavage in or near (e.g. within 1, 2, 3, 4, 5, 6, 7, 8, 9, 10, 20, 50, or more base pairs from) the target sequence, but may depend on for instance secondary structure, in particular in the case of RNA targets.

Signal Amplification CRISPR Effector Proteins

In certain example embodiments, the signal amplification CRISPR effector protein is a Type III-A CRISPR-Cas system effector protein. In certain example embodiments, the Type III-A CRISPR-Cas effector protein is Csm6. Csm6 functions with the multiprotein Csm effector complex, but is not part of the complex (see, e.g., US20170198286 A1; WO2016035044A1; M. Kazlauskiene et al., Science 10.1126/science.aao0100 (2017); and Niewoehner et al. 2017, bioRxiv preprint first posted online Jun. 23, 2017; doi: dx.doi.org/10.1101/153262).

In *Staphylococcus epidermidis* the Csm complex (SeCsm) is comprised of Cas10, Csm2, Csm3, Csm4, and Csm5 proteins. The Type III-A CRISPR-Cas system was demonstrated to have RNA cleavage activity both in vitro and in the cell using the Csm complex for *Streptococcus thermophilus* (St) (see, e.g., US20170198286 A1).

Type III-A CRISPR-Cas systems include *Streptococcus thermophilus* (GenBank KM222358), DGCC7710 (GenBank AWVZ01000003), LMD-9 (GenBank NC008532), *Staphylococcus epidermidis* RP62a (GenBank NC002976), *Enterococcus italicus* DSM15952 (GenBank AEPV01000074), *Lactococcus lactis* DGCC7167 (GenBank JX524189) and *Sulfolobus solfataricus* P2 (GenBank AE006641). The Type III-A system of DGCC8004 contains 10 cas genes flanking the CRISPR2 array and includes cas1, cas2, cas6, cas10, csm2, csm3, csm4, csm5, csm6 and csm6' genes. The DGCC8004 CRISPR2 locus shares a similar gene arrangement to that of DGCC7710 (GenBank AWVZ00000000, (Horvath and Barrangou, 2010)) and LMD-9 (GenBank NC_008532, (Makarova et al., 2006)). The major difference is an additional csm6' gene in DGCC8004. The Csm6' protein in DGCC8004 is comprised of 386 aa and shows—34% amino acid identity to the 428 aa Csm6 protein, suggesting a possible ancient gene duplication event followed by sequence divergence. In contrast, DGCC7710 contains only a short 117-nt ORF in front of csm6. The Cas/Csm proteins associated to CRISPR2 in DGCC8004 are homologous to the corresponding proteins in DGCC7710 and LMD-9 (more than 90% aa identity, except for the Csm2 protein, which shares ~70% identity). Other experimentally characterized Type III-A systems including *S. epidermidis* RP62a (GenBank NC002976, (Marraffini and Sontheimer, 2008)), *Enterococcus italicus* DSM15952 (GenBank AEPV01000074, (Millen et al., 2012)) and *Lactococcus lactis* DGCC7167 (GenBank JX524189, (Millen et al., 2012)) share with DGCC8004 a conserved arrangement of the cas10-csm2-csm3-csm4-csm5-csm6 gene cluster, while the position of cas6 and cas1/cas2 genes differ in some strains. The Type III-A CRISPR-Cas locus in *S. solfataricus* P2 (GenBank AE006641) has different gene organization and shows low protein sequence similarity to Cas/Csm orthologues in DGCC8004. Noteworthy, the Csm3 protein is most conserved among the Cas/Csm proteins across different strains and 5 copies of the Csm3 paralogues are present in *S. solfataricus*. Repeat sequences in *S. epidermidis*, *E. italicus* and *L. lactis* are of the same length (36 nt), however the nucleotide conservation is limited to the palindromic parts and 3'-terminal end of the repeats. The 8-nt 3'-terminal sequence of the repeat, which may contribute to the crRNA 5'-handle, shows an ACGRRAAC consensus between *S. thermophilus, S. epidermidis, E. italicus* and *L. lactis* but differs from that of *S. solfataricus* (AUUGAAG (Rouillon et al., 2013)).

Csm6 has been shown to be a ssRNA-specific endoribonuclease and the structural basis for this activity was determined (Niewoehner and Jinek, 2016, Structural basis for the endoribonuclease activity of the type III-A CRISPR-associated protein Csm6. RNA 22:318-329).

In some embodiments, one or more elements of a nucleic acid-targeting system of the present invention is derived from a particular organism comprising an endogenous CRISPR RNA-targeting system. In certain embodiments, the CRISPR RNA-targeting system comprises a Csm6 protein, Csm6 orthologue, or Csm6-like protein. As used herein, discussion of Csm6 also refers to Csm6 proteins, Csm6 orthologues, or Csm6-like proteins. Csm6 orthologues may be found in organisms as described herein and known in the art (see, e.g., WO2016035044A1 and Niewoehner and Jinek, 2016). Exemplary Csm6 orthologues include, but are not limited to *T. thermophilus* (TtCsm6, GI:55978335), *S. epidermidis* (SeCsm6, GI:488416649), *S. mutans* (SmCsm6, GI:24379650), *S. thermophiles* (StCsm6, GI:585230687), and *P. furiosus* Csx1 (PfCsx1, GI:33359545). In certain embodiments, Csm6 proteins useful for the present invention comprise at least one N-terminal CARF (CRISPR-associated Rossman fold) domain and at least one C-terminal HEPN domain (higher eukaryotes and prokaryotes nucleotide-binding domain). In certain embodiments, Csm6 proteins form dimers. In certain embodiments, dimerization of the HEPN domains leads to the formation of a ribonuclease active site. In certain embodiments, the dimer interface of the CARF domains comprise an electropositive pocket. Not being bound by a theory, the pocket may function as a ligand-binding site for allosteric control of ribonuclease activity.

In certain example embodiments, the CRISPR-based detection systems described herein comprise a Csm6 protein comprising at least one HEPN domain, including but not limited to the HEPN domains described herein, HEPN domains known in the art (Niewoehner and Jinek, 2016), and domains recognized to be HEPN domains by comparison to consensus sequence motifs. Several such domains are provided herein. In one non-limiting example, a consensus sequence can be derived from the sequences of C2c2 or Cas13b orthologs provided herein. In certain example embodiments, the Csm6 protein comprises a single HEPN domain. In certain other example embodiments, the Csm6 protein comprises two HEPN domains.

In one example embodiment, the Csm6 protein comprises one or more HEPN domains comprising an RxxxxH motif sequence. The RxxxxH motif sequence can be, without limitation, from a HEPN domain described herein or a HEPN domain known in the art. RxxxxH motif sequences further include motif sequences created by combining portions of two or more HEPN domains. As noted, consensus sequences can be derived from the sequences of the orthologs disclosed herein. In certain embodiments, the HEPN domain comprises a conserved R-X4-6-H motif (Anantharaman et al., Biol Direct. 2013 Jun. 15; 8:15; and Kim et al., Proteins. 2013 February; 81(2):261-70).

In an embodiment of the invention, a HEPN domain comprises at least one RxxxxH motif comprising the sequence of R{N/H/K}X1X2X3H (SEQ ID NO:571). In an embodiment of the invention, a HEPN domain comprises a RxxxxH motif comprising the sequence of R{N/H}X1X2X3H (SEQ ID NO:572). In an embodiment of the invention, a HEPN domain comprises the sequence of R{N/K}X1X2X3H (SEQ ID NO:573). In certain embodiments, X1 is R, S, D, E, Q, N, G, Y, or H. In certain embodiments, X2 is I, S, T, V, or L. In certain embodiments, X3 is L, F, N, Y, V, I, S, D, E, or A.

CARF domains and consensus sequences for CARF domains have been described (see, e.g., Makarova et al., Front Genet. 2014; 5: 102). In certain embodiments, Csm6 comprises at least one CARF domain comprising a core domain comprising a six-stranded Rossmann-like fold with the core strand-5 and strand-6 forming a β-hairpin. The main regions of sequence conservation are associated with strand-1 and strand-4 of the core domain. In certain embodiments, the end of strand-1 is characterized by a polar residue, typically with an alcoholic side chain (S/T). In certain embodiments, immediately downstream of strand-4 is a highly conserved basic residue (K/R), preferably associated with a [DN]X[ST]XXX[RK](SEQ ID NO:574) signature. In certain embodiments, Csm6 is truncated to remove the N-terminal CARF domain (e.g., amino acids 1-190 of TtCsm6 or the equivalent residues in orthologous Csm6 proteins).

In certain embodiments, Csm6 comprises at least one 6H domain (Niewoehner and Jinek, 2016). The 6H domain of TtCsm6 polypeptide chain (residues 191-292) consists of five α-helices and forms a right-handed solenoid domain. Not being bound by a theory, since some orthologues may not have a 6H domain, this domain is not required for activity of the Csm6 protein of the present invention.

Csm6 has been shown to contribute to interference by functioning as a standalone ribonuclease that degrades invader RNA transcripts. Csm6 proteins are activated through a second messenger generated by the type III interference complex. Upon target RNA binding by the type III interference complex, the Cas10 subunit converts ATP into a cyclic oligoadenylate product, which allosterically activates Csm6 by binding to its CARF domain. CARF domain mutations that abolish allosteric activation inhibit Csm6 activity in vivo, and mutations in the Cas10 Palm domain phenocopy loss of Csm6 (M. Kazlauskiene et al., 2017; and Niewoehner et al. 2017).

In certain example embodiments, the signal amplification CRISPR effector protein is activated when the activated CRISPR detection protein cleaves an activation sequence. The activation sequences are described in further detail below. The cleavage product of the activation sequence activates a separate activity of the signal amplification CRISPR effector protein, such as an RNA nuclease activity. For example, Csm6, once activated, cleaves RNA indiscriminately similar to the collateral effect of Cas13 enzymes. Thus, in addition to detection effector modification of reporter constructs, the activated signal amplification CRISPR effector protein also modifies reporter constructs to further enhance signal generation. In certain embodiments, Csm6 is activated when provided in conjunction with another CRISPR enzyme (e.g., Cas13). In certain embodiments, Csm6 can generate a synergistic effect when used in conjunction with Cas13, such that Cas13 collateral activity is greatly increased. Not being bound by a theory, the concentration of Cas13 can be greatly decreased in an assay when Csm6 is also included in the assay (e.g., point of care assay). Thus, Csm6 addition to a Cas13 diagnostic assay can be used to increase sensitivity of the assay and decrease cost.

In certain example embodiments, the one or more signal amplification effector proteins are selected from Table 4.

TABLE 4

| | | |
|---|---|---|
| EiCsm6 (SEQ ID NO: 121) | WP_007208953.1 | *Enterococcus italicus* |
| TtCsm6 (SEQ ID NO: 122) | WP_011229148.1 | *Thermus thermophilus* |
| StCsm6 (SEQ ID NO: 123) | WP_000865879.1 | *Staphylococcus* |
| ShCsm6 (SEQ ID NO: 124) | WP_085050120.1 | *Staphylococcus haemolyticus* |
| PtCsm6 (SEQ ID NO: 125) | WP_078807318.1 | *Pilibacter termitis* |
| SaCsm6 (SEQ ID NO: 126) | EHO90787.1 | *Staphylococcus aureus* subsp. *aureus* 21252 |

TABLE 4-continued

| | | |
|---|---|---|
| ThCsm6 (SEQ ID NO: 127) | WP_094243908.1 | *Tetragenococcus halophilus* |
| FsCsm6 (SEQ ID NO: 128) | WP_069876671.1 | *Fusibacter* sp. 3D3 |
| LaCsm6 (SEQ ID NO: 129) | WP_056988115.1 | *Lactobacillus acidipiscis* |
| LsCsm6 (SEQ ID NO: 130) | WP_081509150.1 | *Lactobacillus salivarius* |

Activation Sequences

Activation sequences are used in conjunction with the CRISPR signal amplification effector protein. In certain example embodiments, the activation sequences are cleaved by the CRISPR detection effector protein once the CRISPR detection effector protein is activated. Cleavage of the activation sequence results in cleavage fragments that activate the CRISPR signal amplification effector protein. As noted above, in certain example embodiments, activation of the CRISPR signal amplification effector protein leads to synergistic generation of a detectable signal. In certain example embodiments, the activation sequence is a homopolymer oligonucleotide. In certain example embodiments, cleavage of the homopolymer oligonucleotide generates at least one cleavage product having a 3' 2,3 cyclic phosphate which stimulates activation of the CRISPR signal amplification effector protein. In certain example embodiments, the homopolymer is a poly-A oligonucleotide. In certain example embodiments, the activation sequence is 5, 6, 7, 8, 9, 10, 11, 12, 13, 14, 15, 16, 17, 18, 19, 20, 21, 22, 23, 24, 25, 26, 27, 28, 29, or 30 nucleotides in length. In certain example embodiments, the activation sequence is between 5 and 10 nucleotides in length, 5 and 15 nucleotides in length, 5 and 20 nucleotides in length, 5 and 25 nucleotides in length, 5 and 30 nucleotides in length, 10 and 15 nucleotides in length, 10 and 20 nucleotides in length, 10 and 25 nucleotides in length, 10 and 30 nucleotides in length, 15 and 20 nucleotides in length, 15 and 25 nucleotides in length, 15 and 30 nucleotides in length, 20 and 25 nucleotides in length, 20 and 30 nucleotides in length, or 25 and 30 nucleotides in length.

Example activation sequences are shown in Table 5.

TABLE 5

| | |
|---|---|
| rArArArArA | 5A-3OH |
| rArArArArA/3Phos/ | 5A-3P |
| rArArArArArA | 6A-3OH |
| rArArArArArA/3Phos/ | 6A-3P |
| rArArArArArArA | 7A-3OH |
| rArArArArArArA/3Phos/ | 7A-3P |

Reporter Constructs

As used herein, a "reporter construct" refers to a molecule that can be cleaved or otherwise deactivated by an activated CRISPR system effector protein described herein. The term "reporter construct" may also be referred to in the alternative as a "detection construct," or "masking construct." In certain example embodiments, the reporter construct is an RNA-based reporter construct. The reporter construct is configured so that the generation or detection of a positive detectable signal is not achieved unless the CRISPR effector system is activated. A positive detectable signal may be any signal that can be detected using optical, fluorescent, chemiluminescent, electrochemical or other detection methods known in the art. The reporter construct may prevent the generation of a detectable positive signal or mask the presence of a detectable positive signal until the reporter construct is modified by CRISPR effector protein activity.

The term "positive detectable signal" is used to differentiate from other detectable signals that may be detectable in the presence of the reporter construct. For example, in certain embodiments a first signal may be detected when an unmodified reporter construct is present (i.e. a negative detectable signal), which then converts to a second signal (e.g. the positive detectable signal) upon modification of the reporter construct by the activated CRISPR effector protein.

In certain example embodiments, the masking construct may suppress generation of a gene product. The gene product may be encoded by a reporter construct that is added to the sample. The masking construct may be an interfering RNA involved in an RNA interference pathway, such as a shRHN or siRNA. The masking construct may also comprise microRNA (miRNA). While present, the masking construct suppresses expression of the gene product. The gene product may be a fluorescent protein or other RNA transcript or protein that would otherwise be detectable by a labeled probe or antibody but for the presence of the masking construct. Upon activation of the effector protein the masking construct is cleaved or otherwise silenced allowing for expression and detection of the gene product as the positive detectable signal.

In certain example embodiments, the masking construct may sequester one or more reagents needed to generate a detectable positive signal such that release of the one or more reagents from the masking construct results in generation of the detectable positive signal. The one or more reagents may combine to produce a colorimetric signal, a chemiluminescent signal, a fluorescent signal, or any other detectable signal and may comprise any reagents known to be suitable for such a purpose. In certain example embodiments, the one or more reagents are sequestered by RNA aptamers that bind the one or more reagents. The one or more reagents are released when the effector protein is activated upon detection of a target molecule. In certain example embodiments, the one or more reagents is a protein, such as an enzyme, capable of facilitating generation of a detectable signal, such as a colorimetric, chemiluminescent, or fluorescent signal, that is inhibited or sequestered such that the protein cannot generate the detectable signal by the binding of one or more RNA aptamers to the protein. Upon activation of the effector proteins disclosed herein, the RNA aptamers are cleaved or degraded to the extent they no longer inhibit the protein's ability to generate the detectable signal. In certain example embodiments, the aptamer is a thrombin inhibitor aptamer. In certain example embodiments, the thrombin inhibitor aptamer has a sequence of GGGAACAAAGCUGAAGUACUUACCC (SEQ ID NO: 131). When this aptamer is cleaved, thrombin will become active and will cleave a peptide colorimetric or fluorescent substrate. In certain example embodiments, the colorimetric substrate is para-nitroanilide (pNA) covalently linked to the peptide substrate for thrombin. Upon cleavage by thrombin, pNA is released and becomes yellow in color and easily visible to the eye. In certain example embodiments, the fluorescent substrate is 7-amino-4-methylcoumarin, a blue fluorophore that can be detected using a fluorescence detector. Inhibitory aptamers may also be used for horseradish peroxidase (HRP), beta-galactosidase, or calf alkaline phosphatase (CAP) within the general principals laid out above.

In certain embodiments, RNAse activity is detected colorimetrically via cleavage of enzyme-inhibiting aptamers. One potential mode of converting RNAse activity into a colorimetric signal is to couple the cleavage of an RNA aptamer with the re-activation of an enzyme that is capable of producing a colorimetric output. In the absence of RNA cleavage, the intact aptamer will bind to the enzyme target and inhibit its activity. The advantage of this readout system is that the enzyme provides an additional amplification step: once liberated from an aptamer via collateral activity (e.g. Cas13a collateral activity), the colorimetric enzyme will continue to produce colorimetric product, leading to a multiplication of signal.

In certain embodiments, an existing aptamer that inhibits an enzyme with a colorimetric readout is used. Several aptamer/enzyme pairs with colorimetric readouts exist, such as thrombin, protein C, neutrophil elastase, and subtilisin. These proteases have colorimetric substrates based upon pNA and are commercially available. In certain embodiments, a novel aptamer targeting a common colorimetric enzyme is used. Common and robust enzymes, such as beta-galactosidase, horseradish peroxidase, or calf intestinal alkaline phosphatase, could be targeted by engineered aptamers designed by selection strategies such as SELEX. Such strategies allow for quick selection of aptamers with nanomolar binding efficiencies and could be used for the development of additional enzyme/aptamer pairs for colorimetric readout.

In certain embodiments, RNAse activity is detected colorimetrically via cleavage of RNA-tethered inhibitors. Many common colorimetric enzymes have competitive, reversible inhibitors: for example, beta-galactosidase can be inhibited by galactose. Many of these inhibitors are weak, but their effect can be increased by increases in local concentration. By linking local concentration of inhibitors to RNAse activity, colorimetric enzyme and inhibitor pairs can be engineered into RNAse sensors. The colorimetric RNAse sensor based upon small-molecule inhibitors involves three components: the colorimetric enzyme, the inhibitor, and a bridging RNA that is covalently linked to both the inhibitor and enzyme, tethering the inhibitor to the enzyme. In the uncleaved configuration, the enzyme is inhibited by the increased local concentration of the small molecule; when the RNA is cleaved (e.g. by Cas13a collateral cleavage), the inhibitor will be released and the colorimetric enzyme will be activated.

In certain embodiments, RNAse activity is detected colorimetrically via formation and/or activation of G-quadruplexes. G quadruplexes in DNA can complex with heme (iron (III)-protoporphyrin IX) to form a DNAzyme with peroxidase activity. When supplied with a peroxidase substrate (e.g. ABTS: (2,2'-Azinobis [3-ethylbenzothiazoline-6-sulfonic acid]-diammonium salt)), the G-quadruplex-heme complex in the presence of hydrogen peroxide causes oxidation of the substrate, which then forms a green color in solution. An example G-quadruplex forming DNA sequence is: GGGTAGGGCGGGTTGGGA (SEQ ID NO: 132). By hybridizing an RNA sequence to this DNA aptamer, formation of the G-quadruplex structure will be limited. Upon RNAse collateral activation (e.g. C2c2-complex collateral activation), the RNA staple will be cleaved allowing the G quadruplex to form and heme to bind. This strategy is particularly appealing because color formation is enzymatic, meaning there is additional amplification beyond RNAse activation.

In certain example embodiments, the masking construct may be immobilized on a solid substrate in an individual discrete volume (defined further below) and sequesters a single reagent. For example, the reagent may be a bead comprising a dye. When sequestered by the immobilized reagent, the individual beads are too diffuse to generate a detectable signal, but upon release from the masking construct are able to generate a detectable signal, for example by aggregation or simple increase in solution concentration. In certain example embodiments, the immobilized masking agent is an RNA-based aptamer that can be cleaved by the activated effector protein upon detection of a target molecule.

In certain other example embodiments, the masking construct binds to an immobilized reagent in solution thereby blocking the ability of the reagent to bind to a separate labeled binding partner that is free in solution. Thus, upon application of a washing step to a sample, the labeled binding partner can be washed out of the sample in the absence of a target molecule. However, if the effector protein is activated, the masking construct is cleaved to a degree sufficient to interfere with the ability of the masking construct to bind the reagent, thereby allowing the labeled binding partner to bind to the immobilized reagent. Thus, the labeled binding partner remains after the wash step indicating the presence of the target molecule in the sample. In certain aspects, the masking construct that binds the immobilized reagent is an RNA aptamer. The immobilized reagent may be a protein and the labeled binding partner may be a labeled antibody. Alternatively, the immobilized reagent may be a streptavidin and the labeled binding partner may be a labeled biotin. The label on the binding partner used in the above embodiments may be any detectable label known in the art. In addition, other known binding partners may be used in accordance with the overall design described here.

In certain example embodiments, the masking construct may comprise a ribozyme. Ribozymes are RNA molecules having catalytic properties. Ribozymes, both naturally and engineered, comprise or consist of RNA that may be targeted by the effector proteins disclosed herein. The ribozyme may be selected or engineered to catalyze a reaction that either generates a negative detectable signal or prevents generation of a positive control signal. Upon deactivation of the ribozyme by the activated effector protein molecule the reaction generating a negative control signal or preventing generation of a positive detectable signal is removed, thereby allowing a positive detectable signal to be detected. In one example embodiment, the ribozyme may catalyze a colorimetric reaction causing a solution to appear as a first color. When the ribozyme is deactivated, the solution then turns to a second color, the second color being the detectable positive signal. An example of how ribozymes can be used to catalyze a colorimetric reaction is described in Zhao et al. "Signal amplification of glucosamine-6-phosphate based on ribozyme glmS," Biosens Bioelectron. 2014; 16:337-42, and provides an example of how such a system could be modified to work in the context of the embodiments disclosed herein. Alternatively, ribozymes, when present can generate cleavage products of, for example, RNA transcripts. Thus, detection of a positive detectable signal may comprise detection of non-cleaved RNA transcripts that are only generated in the absence of the ribozyme.

In one example embodiment, the masking construct comprises a detection agent that changes color depending on whether the detection agent is aggregated or dispersed in solution. For example, certain nanoparticles, such as colloidal gold, undergo a visible purple to red color shift as they move from aggregates to dispersed particles. Accordingly, in certain example embodiments, such detection agents may be held in aggregate by one or more bridge molecules. At least a portion of the bridge molecule comprises RNA. Upon activation of the effector proteins disclosed herein, the RNA portion of the bridge molecule is cleaved, allowing the detection agent to disperse and resulting in the corresponding change in color. In certain example embodiments, the bridge molecule is an RNA molecule. In certain example embodiments, the detection agent is a colloidal metal. The colloidal metal material may include water-insoluble metal particles or metallic compounds dispersed in a liquid, a hydrosol, or a metal sol. The colloidal metal may be selected from the metals in groups IA, IB, IIB and IIIB of the periodic table, as well as the transition metals, especially those of group VIII. Preferred metals include gold, silver, aluminum, ruthenium, zinc, iron, nickel and calcium. Other suitable metals also include the following in all of their various oxidation states: lithium, sodium, magnesium, potassium, scandium, titanium, vanadium, chromium, manganese, cobalt, copper, gallium, strontium, niobium, molybdenum, palladium, indium, tin, tungsten, rhenium, platinum, and gadolinium. The metals are preferably provided in ionic form, derived from an appropriate metal compound, for example the $Al3+$, $Ru3+$, $Zn2+$, $Fe3+$, $Ni2+$ and $Ca2+$ ions.

In certain other example embodiments, the masking construct may comprise an RNA oligonucleotide to which are attached a detectable label and a masking agent of that detectable label. An example of such a detectable label/masking agent pair is a fluorophore and a quencher of the fluorophore. Quenching of the fluorophore can occur as a result of the formation of a non-fluorescent complex between the fluorophore and another fluorophore or non-fluorescent molecule. This mechanism is known as ground-state complex formation, static quenching, or contact quenching. Accordingly, the RNA oligonucleotide may be designed so that the fluorophore and quencher are in sufficient proximity for contact quenching to occur. Fluorophores and their cognate quenchers are known in the art and can be selected for this purpose by one having ordinary skill in the art. The particular fluorophore/quencher pair is not critical in the context of this invention, only that selection of the fluorophore/quencher pairs ensures masking of the fluorophore. Upon activation of the effector proteins disclosed herein, the RNA oligonucleotide is cleaved, thereby severing the proximity between the fluorophore and quencher needed to maintain the contact quenching effect. Accordingly, detection of the fluorophore may be used to determine the presence of a target molecule in a sample.

In certain other example embodiments, the masking construct may comprise one or more RNA oligonucleotides to which are attached one or more metal nanoparticles, such as gold nanoparticles. In some embodiments, the masking construct comprises a plurality of metal nanoparticles cross-linked by a plurality of RNA oligonucleotides forming a closed loop. In one embodiment, the masking construct comprises three gold nanoparticles crosslinked by three RNA oligonucleotides forming a closed loop. In some embodiments, the cleavage of the RNA oligonucleotides by the CRISPR effector protein leads to a detectable signal produced by the metal nanoparticles.

In certain other example embodiments, the masking construct may comprise one or more RNA oligonucleotides to which are attached one or more quantum dots. In some embodiments, the cleavage of the RNA oligonucleotides by the CRISPR effector protein leads to a detectable signal produced by the quantum dots.

In one example embodiment, the masking construct may comprise a quantum dot. The quantum dot may have multiple linker molecules attached to the surface. At least a portion of the linker molecule comprises RNA. The linker molecule is attached to the quantum dot at one end and to one or more quenchers along the length or at terminal ends of the linker such that the quenchers are maintained in sufficient proximity for quenching of the quantum dot to occur. The linker may be branched. As above, the quantum dot/quencher pair is not critical, only that selection of the quantum dot/quencher pair ensures masking of the fluorophore. Quantum dots and their cognate quenchers are known in the art and can be selected for this purpose by one having ordinary skill in the art. Upon activation of the effector proteins disclosed herein, the RNA portion of the linker molecule is cleaved, thereby eliminating the proximity between the quantum dot and one or more quenchers needed to maintain the quenching effect. In certain example embodiments, the quantum dot is streptavidin conjugated. RNAs are attached via biotin linkers and recruit quenching molecules with the sequences /5Biosg/UCUCGUACGUUC/ 3IAbRQSp/(SEQ ID NO: 133) or /5Biosg/ UCUCGUACGUUCUCUCGUACGUUC/3IAbRQSp/ (SEQ ID NO: 134), where /5Biosg/ is a biotin tag and /31AbRQSp/ is an Iowa black quencher. Upon cleavage by the activated effectors disclosed herein, the quantum dot will fluoresce visibly.

In a similar fashion, fluorescence energy transfer (FRET) may be used to generate a detectable positive signal. FRET is a non-radiative process by which a photon from an energetically excited fluorophore (i.e. "donor fluorophore") raises the energy state of an electron in another molecule (i.e. "the acceptor") to higher vibrational levels of the excited singlet state. The donor fluorophore returns to the ground state without emitting a fluorescence characteristic of that fluorophore. The acceptor can be another fluorophore or non-fluorescent molecule. If the acceptor is a fluorophore, the transferred energy is emitted as fluorescence characteristic of that fluorophore. If the acceptor is a non-fluorescent molecule the absorbed energy is lost as heat. Thus, in the context of the embodiments disclosed herein, the fluorophore/quencher pair is replaced with a donor fluorophore/ acceptor pair attached to the oligonucleotide molecule. When intact, the masking construct generates a first signal (negative detectable signal) as detected by the fluorescence or heat emitted from the acceptor. Upon activation of the effector proteins disclosed herein the RNA oligonucleotide is cleaved and FRET is disrupted such that fluorescence of the donor fluorophore is now detected (positive detectable signal).

In certain example embodiments, the masking construct comprises the use of intercalating dyes which change their absorbance in response to cleavage of long RNAs to short nucleotides. Several such dyes exist. For example, pyronine-Y will complex with RNA and form a complex that has an absorbance at 572 nm. Cleavage of the RNA results in loss of absorbance and a color change. Methylene blue may be used in a similar fashion, with changes in absorbance at 688 nm upon RNA cleavage. Accordingly, in certain example embodiments the masking construct comprises an RNA and intercalating dye complex that changes absorbance upon the cleavage of RNA by the effector proteins disclosed herein.

Amplification

In certain example embodiments, target RNAs and/or DNAs may be amplified prior to activating the CRISPR effector protein. Any suitable RNA or DNA amplification technique may be used. In certain example embodiments, the RNA or DNA amplification is an isothermal amplification. In certain example embodiments, the isothermal amplification may be nucleic-acid sequence-based amplification (NASBA), recombinase polymerase amplification (RPA), loop-mediated isothermal amplification (LAMP), strand displacement amplification (SDA), helicase-dependent amplification (HDA), or nicking enzyme amplification reaction (NEAR). In certain example embodiments, non-isothermal amplification methods may be used which include, but are not limited to, PCR, multiple displacement amplification (MDA), rolling circle amplification (RCA), ligase chain reaction (LCR), or ramification amplification method (RAM).

In certain example embodiments, the RNA or DNA amplification nucleic acid sequence-based amplification is NASBA, which is initiated with reverse transcription of target RNA by a sequence-specific reverse primer to create an RNA/DNA duplex. RNase H is then used to degrade the RNA template, allowing a forward primer containing a promoter, such as the T7 promoter, to bind and initiate elongation of the complementary strand, generating a double-stranded DNA product. The RNA polymerase promoter-mediated transcription of the DNA template then creates copies of the target RNA sequence. Importantly, each of the new target RNAs can be detected by the guide RNAs, thus further enhancing the sensitivity of the assay. Binding of the target RNAs by the guide RNAs then leads to activation of the CRISPR effector protein and the methods proceed as outlined above. The NASBA reaction has the additional advantage of being able to proceed under moderate isothermal conditions, for example at approximately 41° C., making it suitable for systems and devices deployed for early and direct detection in the field and far from clinical laboratories.

In certain other example embodiments, a recombinase polymerase amplification (RPA) reaction may be used to amplify the target nucleic acids. RPA reactions employ recombinases which are capable of pairing sequence-specific primers with homologous sequences in duplex DNA. If target DNA is present, DNA amplification is initiated and no other sample manipulation such as thermal cycling or chemical melting is required. The entire RPA amplification system is stable as a dried formulation and can be transported safely without refrigeration. RPA reactions may also be carried out at isothermal temperatures with an optimum reaction temperature of 37-42° C. The sequence specific primers are designed to amplify a sequence comprising the target nucleic acid sequence to be detected. In certain example embodiments, an RNA polymerase promoter, such as a T7 promoter, is added to one of the primers. This results in an amplified double-stranded DNA product comprising the target sequence and an RNA polymerase promoter. After, or during, the RPA reaction, an RNA polymerase is added that will produce RNA from the double-stranded DNA templates. The amplified target RNA can then in turn be detected by the CRISPR effector system. In this way target DNA can be detected using the embodiments disclosed herein. RPA reactions can also be used to amplify target RNA. The target RNA is first converted to cDNA using a reverse transcriptase, followed by second strand DNA synthesis, at which point the RPA reaction proceeds as outlined above.

Accordingly, in certain example embodiments the systems disclosed herein may include amplification reagents. Different components or reagents useful for amplification of nucleic acids are described herein. For example, an amplification reagent as described herein may include a buffer, such as a Tris buffer. A Tris buffer may be used at any concentration appropriate for the desired application or use, for example including, but not limited to, a concentration of 1 mM, 2 mM, 3 mM, 4 mM, 5 mM, 6 mM, 7 mM, 8 mM, 9 mM, 10 mM, 11 mM, 12 mM, 13 mM, 14 mM, 15 mM, 25 mM, 50 mM, 75 mM, 1 M, or the like. One of skill in the art will be able to determine an appropriate concentration of a buffer such as Tris for use with the present invention.

A salt, such as magnesium chloride ($MgCl_2$), potassium chloride (KCl), or sodium chloride (NaCl), may be included in an amplification reaction, such as PCR, in order to improve the amplification of nucleic acid fragments. Although the salt concentration will depend on the particular reaction and application, in some embodiments, nucleic acid fragments of a particular size may produce optimum results at particular salt concentrations. Larger products may require altered salt concentrations, typically lower salt, in order to produce desired results, while amplification of smaller products may produce better results at higher salt concentrations. One of skill in the art will understand that the presence and/or concentration of a salt, along with alteration of salt concentrations, may alter the stringency of a biological or chemical reaction, and therefore any salt may be used that provides the appropriate conditions for a reaction of the present invention and as described herein.

Other components of a biological or chemical reaction may include a cell lysis component in order to break open or lyse a cell for analysis of the materials therein. A cell lysis component may include, but is not limited to, a detergent, a salt as described above, such as NaCl, KCl, ammonium sulfate [$(NH_4)_2SO_4$], or others. Detergents that may be appropriate for the invention may include Triton X-100, sodium dodecyl sulfate (SDS), CHAPS (3-[(3-cholamidopropyl)dimethylammonio]-1-propanesulfonate), ethyl trimethyl ammonium bromide, nonyl phenoxypolyethoxylethanol (NP-40). Concentrations of detergents may depend on the particular application, and may be specific to the reaction in some cases. Amplification reactions may include dNTPs and nucleic acid primers used at any concentration appropriate for the invention, such as including, but not limited to, a concentration of 100 nM, 150 nM, 200 nM, 250 nM, 300 nM, 350 nM, 400 nM, 450 nM, 500 nM, 550 nM, 600 nM, 650 nM, 700 nM, 750 nM, 800 nM, 850 nM, 900 nM, 950 nM, 1 mM, 2 mM, 3 mM, 4 mM, 5 mM, 6 mM, 7 mM, 8 mM, 9 mM, 10 mM, 20 mM, 30 mM, 40 mM, 50 mM, 60 mM, 70 mM, 80 mM, 90 mM, 100 mM, 150 mM, 200 mM, 250 mM, 300 mM, 350 mM, 400 mM, 450 mM, 500 mM, or the like. Likewise, a polymerase useful in accordance with the invention may be any specific or general polymerase known in the art and useful for the invention, including Taq polymerase, Q5 polymerase, or the like.

In some embodiments, amplification reagents as described herein may be appropriate for use in hot-start amplification. Hot start amplification may be beneficial in some embodiments to reduce or eliminate dimerization of adaptor molecules or oligos, or to otherwise prevent unwanted amplification products or artifacts and obtain optimum amplification of the desired product. Many components described herein for use in amplification may also be used in hot-start amplification. In some embodiments, reagents or components appropriate for use with hot-start amplification may be used in place of one or more of the composition components as appropriate. For example, a polymerase or other reagent may be used that exhibits a desired activity at a particular temperature or other reaction condition. In some embodiments, reagents may be used that are designed or optimized for use in hot-start amplification, for example, a polymerase may be activated after transposition or after reaching a particular temperature. Such polymerases may be antibody-based or aptamer-based. Polymerases as described herein are known in the art. Examples of such reagents may include, but are not limited to, hot-start polymerases, hot-start dNTPs, and photo-caged dNTPs. Such reagents are known and available in the art. One of skill in the art will be able to determine the optimum temperatures as appropriate for individual reagents.

Amplification of nucleic acids may be performed using specific thermal cycle machinery or equipment, and may be performed in single reactions or in bulk, such that any desired number of reactions may be performed simultaneously. In some embodiments, amplification may be performed using microfluidic or robotic devices, or may be performed using manual alteration in temperatures to achieve the desired amplification. In some embodiments, optimization may be performed to obtain the optimum reaction conditions for the particular application or materials. One of skill in the art will understand and be able to optimize reaction conditions to obtain sufficient amplification.

In certain embodiments, detection of DNA with the methods or systems of the invention requires transcription of the (amplified) DNA into RNA prior to detection.

Guide Release and Target Generation Based Signal Amplification

In certain example embodiments, the compositions, systems, and methods disclosed herein may further comprise the addition of a secondary target. The secondary target is distinct from the primary target and may be generic across assays. The secondary target may be added to each assay at high concentration. A corresponding guide sequence to the secondary target is included in each assay volume. The secondary target guide sequence would be protected such that it would not be able to bind the secondary target or a detection CRISPR effector protein, such as a Cas13 protein. The protecting group or structure is configured such that it can be cleaved upon activation of the detection CRISPR effector protein. Once the protecting group or structure is removed, the released guide sequence is able to form a complex with detection CRISPR effector proteins in solution and trigger further activation of the detection CRISPR effector protein and thereby leading to further generation of a detectable signal by modification of the reporter constructs.

Alternatively, the secondary guide sequence may be added to each assay volume along with a protected target. Cleavage of the protector group or structure off the target by activated detection CRISPR effector protein would allow additional CRISPR effector protein/guide sequence/secondary target sequence complexes to form, further increasing the collateral effect.

In certain example embodiments, the protecting group or structure may be a blocking secondary structure loop that is cleaved off by collateral activity.

In another aspect, the activated collateral effect could cleave a protected or circularized primer, which would be released to perform an amplification reaction on a template for either guide sequence, target sequence or both. In certain example embodiments, the amplification reaction is an isothermal amplification reaction, such as a recombinase polymerase amplification, or rolling circle amplification. Subsequent transcription of the amplified template would produce more guide sequence and/or target, allowing for additional detection CRISPR effector protein activation.

Target RNA/DNA Enrichment

In certain example embodiments, target RNA or DNA may first be enriched prior to detection or amplification of the target RNA or DNA. In certain example embodiments, this enrichment may be achieved by binding of the target nucleic acids by a CRISPR effector system.

Current target-specific enrichment protocols require single-stranded nucleic acid prior to hybridization with probes. Among various advantages, the present embodiments can skip this step and enable direct targeting to double-stranded DNA (either partly or completely double-stranded). In addition, the embodiments disclosed herein are enzyme-driven targeting methods that offer faster kinetics and easier workflow allowing for isothermal enrichment. In certain example embodiments, enrichment may take place between 20-37° C. In certain example embodiments, a set of guide RNAs to different target nucleic acids are used in a single assay, allowing for detection of multiple targets and/or multiple variants of a single target.

In certain example embodiments, the dead CRISPR effector protein may bind the target nucleic acid in solution and then subsequently be isolated from said solution. For example, the dead CRISPR effector protein bound to the target nucleic acid may be isolated from the solution using an antibody or other molecule, such as an aptamer, that specifically binds the dead CRISPR effector protein.

In other example embodiments, the dead CRISPR effector protein may be bound to a solid substrate. A fixed substrate may refer to any material that is appropriate for or can be modified to be appropriate for the attachment of a polypeptide or a polynucleotide. Possible substrates include, but are not limited to, glass and modified functionalized glass, plastics (including acrylics, polystyrene and copolymers of styrene and other materials, polypropylene, polyethylene, polybutylene, polyurethanes, Teflon™, etc.), polysaccharides, nylon or nitrocellulose, ceramics, resins, silica or silica-based materials including silicon and modified silicon, carbon, metals, inorganic glasses, plastics, optical fiber bundles, and a variety of other polymers. In some embodiments, the solid support comprises a patterned surface suitable for immobilization of molecules in an ordered pattern. In certain embodiments, a patterned surface refers to an arrangement of different regions in or on an exposed layer of a solid support. In some embodiments, the solid support comprises an array of wells or depressions in a surface. The composition and geometry of the solid support can vary with its use. In some embodiments, the solids support is a planar structure such as a slide, chip, microchip and/or array. As such, the surface of the substrate can be in the form of a planar layer. In some embodiments, the solid support comprises one or more surfaces of a flowcell. The term "flow-cell" as used herein refers to a chamber comprising a solid surface across which one or more fluid reagents can be flowed. Example flowcells and related fluidic systems and detection platforms that can be readily used in the methods of the present disclosure are described, for example, in Bentley et al. Nature 456:53-59 (2008), WO 04/0918497, U.S. Pat. No. 7,057,026; WO 91/06678; WO 07/123744; U.S. Pat. Nos. 7,329,492; 7,211,414; 7,315,019; 7,405,281, and US 2008/0108082. In some embodiments, the solid support or its surface is non-planar, such as the inner or outer surface of a tube or vessel. In some embodiments, the solid support comprises microspheres or beads. "Microspheres," "beads," "particles," are intended to mean within the context of a solid substrate, small discrete particles made of various materials including, but not limited to, plastics, ceramics, glass, and polystyrene. In certain embodiments, the microspheres are magnetic microspheres or beads. Alternatively or additionally, the beads may be porous. The bead sizes range from nanometers, e.g. 100 nm, to millimeters, e.g. 1 mm.

A sample containing, or suspected of containing, the target nucleic acids may then be exposed to the substrate to allow binding of the target nucleic acids to the bound dead CRISPR effector protein. Non-target molecules may then be washed away. In certain example embodiments, the target nucleic acids may then be released from the CRISPR effector protein/guide RNA complex for further detection using the methods disclosed herein. In certain example embodiments, the target nucleic acids may first be amplified as described herein.

In certain example embodiments, the CRISPR effector may be labeled with a binding tag. In certain example embodiments, the CRISPR effector may be chemically tagged. For example, the CRISPR effector may be chemically biotinylated. In another example embodiment, a fusion may be created by adding additional sequence encoding a fusion to the CRISPR effector. One example of such a fusion is an AviTag™, which employs a highly targeted enzymatic conjugation of a single biotin on a unique 15 amino acid peptide tag. In certain embodiments, the CRISPR effector may be labeled with a capture tag such as, but not limited to, GST, Myc, hemagglutinin (HA), green fluorescent protein (GFP), flag, His tag, TAP tag, and Fc tag. The binding tag, whether a fusion, chemical tag, or capture tag, may be used to either pull down the CRISPR effector system once it has bound a target nucleic acid or to fix the CRISPR effector system on the solid substrate.

In certain example embodiments, the guide RNA may be labeled with a binding tag. In certain example embodiments, the entire guide RNA may be labeled using in vitro transcription (IVT) incorporating one or more biotinylated nucleotides, such as, biotinylated uracil. In some embodiments, biotin can be chemically or enzymatically added to the guide RNA, such as, the addition of one or more biotin groups to the 3' end of the guide RNA. The binding tag may be used to pull down the guide RNA/target nucleic acid complex after binding has occurred, for example, by exposing the guide RNA/target nucleic acid to a streptavidin coated solid substrate.

Accordingly, in certain example embodiments, an engineered or non-naturally-occurring CRISPR effector may be used for enrichment purposes. In an embodiment, the modification may comprise mutation of one or more amino acid residues of the effector protein. The one or more mutations may be in one or more catalytically active domains of the effector protein. The effector protein may have reduced or abolished nuclease activity compared with an effector protein lacking said one or more mutations. The effector protein may not direct cleavage of the RNA strand at the target locus of interest. In a preferred embodiment, the one or more mutations may comprise two mutations. In a preferred embodiment, the one or more amino acid residues are modified in a C2c2 effector protein, e.g., an engineered or non-naturally-occurring effector protein or C2c2. In particular embodiments, the one or more modified or mutated amino acid residues are one or more of those in C2c2 corresponding to R597, H602, R1278 and H1283 (referenced to Lsh C2c2 amino acids), such as mutations R597A, H602A, R1278A and H1283A, or the corresponding amino acid residues in Lsh C2c2 orthologues.

In particular embodiments, the one or more modified or mutated amino acid residues are one or more of those in C2c2 corresponding to K2, K39, V40, E479, L514, V518, N524, G534, K535, E580, L597, V602, D630, F676, L709, I713, R717 (HEPN), N718, H722 (HEPN), E773, P823, V828, I879, Y880, F884, Y997, L1001, F1009, L1013, Y1093, L1099, L1111, Y1114, L1203, D1222, Y1244, L1250, L1253, K1261, I1334, L1355, L1359, R1362, Y1366, E1371, R1372, D1373, R1509 (HEPN), H1514

(HEPN), Y1543, D1544, K1546, K1548, V1551, 11558, according to C2c2 consensus numbering. In certain embodiments, the one or more modified or mutated amino acid residues are one or more of those in C2c2 corresponding to R717 and R1509. In certain embodiments, the one or more modified or mutated amino acid residues are one or more of those in C2c2 corresponding to K2, K39, K535, K1261, R1362, R1372, K1546 and K1548. In certain embodiments, said mutations result in a protein having an altered or modified activity. In certain embodiments, said mutations result in a protein having a reduced activity, such as reduced specificity. In certain embodiments, said mutations result in a protein having no catalytic activity (i.e. "dead" C2c2). In an embodiment, said amino acid residues correspond to Lsh C2c2 amino acid residues, or the corresponding amino acid residues of a C2c2 protein from a different species. Devices that can facilitate these steps.

The above enrichment systems may also be used to deplete a sample of certain nucleic acids. For example, guide RNAs may be designed to bind non-target RNAs to remove the non-target RNAs from the sample. In one example embodiment, the guide RNAs may be designed to bind nucleic acids that do carry a particular nucleic acid variation. For example, in a given sample, a higher copy number of non-variant nucleic acids may be expected. Accordingly, the embodiments disclosed herein may be used to remove the non-variant nucleic acids from a sample, to increase the efficiency with which the detection CRISPR effector system can detect the target variant sequences in a given sample.

Detection of Proteins

The systems, devices, and methods disclosed herein may be adapted for detection of polypeptides (or other molecules) in addition to detection of nucleic acids, via incorporation of a specifically configured polypeptide detection aptamer. The polypeptide detection aptamers are distinct from the masking construct aptamers discussed above. First, the aptamers are designed to specifically bind to one or more target molecules. In one example embodiment, the target molecule is a target polypeptide. In another example embodiment, the target molecule is a target chemical compound, such as a target therapeutic molecule. Methods for designing and selecting aptamers with specificity for a given target, such as SELEX, are known in the art. In addition to specificity to a given target, the aptamers are further designed to incorporate an RNA polymerase promoter binding site. In certain example embodiments, the RNA polymerase promoter is a T7 promoter. Prior to binding to a target, the RNA polymerase site is not accessible or otherwise recognizable to an RNA polymerase. However, the aptamer is configured so that upon binding of a target the structure of the aptamer undergoes a conformational change such that the RNA polymerase promoter is exposed. An aptamer sequence downstream of the RNA polymerase promoter acts as a template for generation of a trigger RNA oligonucleotide by an RNA polymerase. Thus, the template portion of the aptamer may further incorporate a barcode or other identifying sequence that identifies a given aptamer and its target. Guide RNAs as described above may then be designed to recognize these specific trigger oligonucleotide sequences. Binding of the guide RNAs to the trigger oligonucleotides activates the CRISPR effector proteins which proceed to deactivate the masking constructs and generate a positive detectable signal as described previously.

Accordingly, in certain example embodiments, the methods disclosed herein comprise the additional step of distributing a sample or set of sample into a set of individual discrete volumes, each individual discrete volume comprising peptide detection aptamers, a CRISPR effector protein, one or more guide RNAs, a masking construct, and incubating the sample or set of samples under conditions sufficient to allow binding of the peptide detection aptamers to the one or more target molecules, wherein binding of the aptamer to a corresponding target exposed the RNA polymerase promoter binding site resulting in synthesis of a trigger RNA via binding of an RNA polymerase to the RNA polymerase promoter binding site.

In another example embodiment, binding of the aptamer may expose a primer binding site upon binding of the aptamer to a target polypeptide. For example, the aptamer may expose an RPA primer binding site. Thus, the addition or inclusion of the primer will then feed into an amplification reaction, such as the RPA reaction as outlined above.

Devices

The systems described herein can be embodied on diagnostic devices. A number of substrates and configurations of devices capable of defining multiple individual discrete volumes within the device may be used. As used herein "individual discrete volume" refers to a discrete space, such as a container, receptacle, or other arbitrary defined volume or space that can be defined by properties that prevent and/or inhibit migration of target molecules, for example a volume or space defined by physical properties such as walls, for example the walls of a well, tube, or a surface of a droplet, which may be impermeable or semipermeable, or as defined by other means such as chemical, diffusion rate limited, electro-magnetic, or light illumination, or any combination thereof that can contain a target molecule and an indexable nucleic acid identifier (for example nucleic acid barcode). By "diffusion rate limited" (for example diffusion defined volumes) is meant spaces that are only accessible to certain molecules or reactions because diffusion constraints effectively defining a space or volume as would be the case for two parallel laminar streams where diffusion will limit the migration of a target molecule from one stream to the other. By "chemical" defined volume or space is meant spaces where only certain target molecules can exist because of their chemical or molecular properties, such as size, where for example gel beads may exclude certain species from entering the beads but not others, such as by surface charge, matrix size or other physical property of the bead that can allow selection of species that may enter the interior of the bead. By "electro-magnetically" defined volume or space is meant spaces where the electro-magnetic properties of the target molecules or their supports such as charge or magnetic properties can be used to define certain regions in a space such as capturing magnetic particles within a magnetic field or directly on magnets. By "optically" defined volume is meant any region of space that may be defined by illuminating it with visible, ultraviolet, infrared, or other wavelengths of light such that only target molecules within the defined space or volume may be labeled. One advantage to the use of non-walled, or semipermeable discrete volumes is that some reagents, such as buffers, chemical activators, or other agents may be passed through the discrete volume, while other materials, such as target molecules, may be maintained in the discrete volume or space. Typically, a discrete volume will include a fluid medium, (for example, an aqueous solution, an oil, a buffer, and/or a media capable of supporting cell growth) suitable for labeling of the target molecule with the indexable nucleic acid identifier under conditions that permit labeling. Exemplary discrete volumes or spaces useful in the disclosed methods include droplets (for example, microfluidic droplets and/or emulsion droplets), hydrogel beads or other polymer structures (for example poly-ethylene glycol di-acrylate beads or agarose beads), tissue slides (for example, fixed formalin paraffin embedded tissue slides with particular regions, volumes, or spaces defined by chemical, optical, or physical means), microscope slides with regions defined by depositing reagents in ordered arrays or random patterns, tubes (such as, centrifuge tubes, microcentrifuge tubes, test tubes, cuvettes, conical tubes, and the like), bottles (such as glass bottles, plastic bottles, ceramic bottles, Erlenmeyer flasks, scintillation vials and the like), wells (such as wells in a plate), plates, pipettes, or pipette tips among others. In certain embodiments, the compartment is an aqueous droplet in a water-in-oil emulsion. In specific embodiments, any of the applications, methods, or systems described herein requiring exact or uniform volumes may employ the use of an acoustic liquid dispenser.

In certain example embodiments, the device comprises a flexible material substrate on which a number of spots may be defined. Flexible substrate materials suitable for use in diagnostics and biosensing are known within the art. The flexible substrate materials may be made of plant derived fibers, such as cellulosic fibers, or may be made from flexible polymers such as flexible polyester films and other polymer types. Within each defined spot, reagents of the system described herein are applied to the individual spots. Each spot may contain the same reagents except for a different guide RNA or set of guide RNAs, or where applicable, a different detection aptamer to screen for multiple targets at once. Thus, the systems and devices herein may be able to screen samples from multiple sources (e.g. multiple clinical samples from different individuals) for the presence of the same target, or a limited number of targets, or aliquots of a single sample (or multiple samples from the same source) for the presence of multiple different targets in the sample. In certain example embodiments, the elements of the systems described herein are freeze dried onto the paper or cloth substrate. Example flexible material based substrates that may be used in certain example devices are disclosed in Pardee et al. *Cell.* 2016, 165(5):1255-66 and Pardee et al. *Cell.* 2014, 159(4):950-54. Suitable flexible material-based substrates for use with biological fluids, including blood are disclosed in International Patent Application Publication No. WO/2013/071301 entitled "Paper based diagnostic test" to Shevkoplyas et al. U.S. Patent Application Publication No. 2011/0111517 entitled "Paper-based microfluidic systems" to Siegel et al. and Shafiee et al. "Paper and Flexible Substrates as Materials for Biosensing Platforms to Detect Multiple Biotargets" Scientific Reports 5:8719 (2015). Further flexible based materials, including those suitable for use in wearable diagnostic devices are disclosed in Wang et al. "Flexible Substrate-Based Devices for Point-of-Care Diagnostics" Cell 34(11):909-21 (2016). Further flexible based materials may include nitrocellulose, polycarbonate, methylethyl cellulose, polyvinylidene fluoride (PVDF), polystyrene, or glass (see e.g., US20120238008). In certain embodiments, discrete volumes are separated by a hydrophobic surface, such as but not limited to wax, photoresist, or solid ink.

In some embodiments, a dosimeter or badge may be provided that serves as a sensor or indicator such that the wearer is notified of exposure to certain microbes or other agents. For example, the systems described herein may be used to detect a particular pathogen. Likewise, aptamer based embodiments disclosed above may be used to detect both polypeptide as well as other agents, such as chemical agents, to which a specific aptamer may bind. Such a device may be useful for surveillance of soldiers or other military personnel, as well as clinicians, researchers, hospital staff, and the like, in order to provide information relating to exposure to potentially dangerous microbes as quickly as possible, for example for biological or chemical warfare agent detection. In other embodiments, such a surveillance badge may be used for preventing exposure to dangerous microbes or pathogens in immunocompromised patients, burn patients, patients undergoing chemotherapy, children, or elderly individuals.

Samples sources that may be analyzed using the systems and devices described herein include biological samples of a subject or environmental samples. Environmental samples may include surfaces or fluids. The biological samples may include, but are not limited to, saliva, blood, plasma, sera, stool, urine, sputum, mucous, lymph, synovial fluid, spinal fluid, cerebrospinal fluid, a swab from skin or a mucosal membrane, or combination thereof. In an example embodiment, the environmental sample is taken from a solid surface, such as a surface used in the preparation of food or other sensitive compositions and materials.

In other example embodiments, the elements of the systems described herein may be placed on a single use substrate, such as swab or cloth that is used to swab a surface or sample fluid. For example, the system could be used to test for the presence of a pathogen on a food by swabbing the surface of a food product, such as a fruit or vegetable. Similarly, the single use substrate may be used to swab other surfaces for detection of certain microbes or agents, such as for use in security screening. Single use substrates may also have applications in forensics, where the CRISPR systems are designed to detect, for example identifying DNA SNPs that may be used to identify a suspect, or certain tissue or cell markers to determine the type of biological matter present in a sample. Likewise, the single use substrate could be used to collect a sample from a patient—such as a saliva sample from the mouth—or a swab of the skin. In other embodiments, a sample or swab may be taken of a meat product in order to detect the presence of absence of contaminants on or within the meat product.

Near-real-time microbial diagnostics are needed for food, clinical, industrial, and other environmental settings (see e.g., Lu T K, Bowers J, and Koeris M S., Trends Biotechnol. 2013 June; 31(6):325-7). In certain embodiments, the present invention is used for rapid detection of foodborne pathogens using guide RNAs specific to a pathogen (e.g., *Campylobacter jejuni, Clostridium perfringens, Salmonella* spp., *Escherichia coli, Bacillus cereus, Listeria monocytogenes, Shigella* spp., *Staphylococcus aureus, Staphylococcal enteritis, Streptococcus, Vibrio cholerae, Vibrio parahaemolyticus, Vibrio vulnificus, Yersinia enterocolitica* and *Yersinia pseudotuberculosis, Brucella* spp., *Corynebacterium ulcerans, Coxiella burnetii,* or *Plesiomonas shigelloides*).

In certain embodiments, the device is or comprises a flow strip. For instance, a lateral flow strip allows for RNAse (e.g. C2c2) detection by color. The RNA reporter is modified to have a first molecule (such as for instance FITC) attached to the 5' end and a second molecule (such as for instance biotin) attached to the 3' end (or vice versa). The lateral flow strip is designed to have two capture lines with anti-first molecule (e.g. anti-FITC) antibodies hybridized at the first line and anti-second molecule (e.g. anti-biotin) antibodies at the second downstream line. As the SHERLOCK reaction flows down the strip, uncleaved reporter will bind to anti-first molecule antibodies at the first capture line, while cleaved reporters will liberate the second molecule and allow second molecule binding at the second capture line. Second molecule sandwich antibodies, for instance conjugated to nanoparticles, such as gold nanoparticles, will bind any second molecule at the first or second line and result in a strong readout/signal (e.g. color). As more reporter is cleaved, more signal will accumulate at the second capture line and less signal will appear at the first line. In certain aspects, the invention relates to the use of a flow strip as described herein for detecting nucleic acids or polypeptides. In certain aspects, the invention relates to a method for detecting nucleic acids or polypeptides with a flow strip as defined herein, e.g. (lateral) flow tests or (lateral) flow immunochromatographic assays.

In certain example embodiments, the device is a microfluidic device that generates and/or merges different droplets (i.e. individual discrete volumes). For example, a first set of droplets may be formed containing samples to be screened and a second set of droplets formed containing the elements of the systems described herein. The first and second set of droplets are then merged and then diagnostic methods as described herein are carried out on the merged droplet set. Microfluidic devices disclosed herein may be silicone-based chips and may be fabricated using a variety of techniques, including, but not limited to, hot embossing, molding of elastomers, injection molding, LIGA, soft lithography, silicon fabrication and related thin film processing techniques. Suitable materials for fabricating the microfluidic devices include, but are not limited to, cyclic olefin copolymer (COC), polycarbonate, poly(dimethylsiloxane) (PDMS), and poly(methylacrylate) (PMMA). In one embodiment, soft lithography in PDMS may be used to prepare the microfluidic devices. For example, a mold may be made using photolithography which defines the location of flow channels, valves, and filters within a substrate. The substrate material is poured into a mold and allowed to set to create a stamp. The stamp is then sealed to a solid support, such as but not limited to, glass. Due to the hydrophobic nature of some polymers, such as PDMS, which absorbs some proteins and may inhibit certain biological processes, a passivating agent may be necessary (Schoffner et al. *Nucleic Acids Research*, 1996, 24:375-379). Suitable passivating agents are known in the art and include, but are not limited to, silanes, parylene, n-Dodecyl-b-D-matoside (DDM), pluronic, Tween-20, other similar surfactants, polyethylene glycol (PEG), albumin, collagen, and other similar proteins and peptides.

In certain example embodiments, the system and/or device may be adapted for conversion to a flow-cytometry readout and/or allow for sensitive and quantitative measurements of millions of cells in a single experiment and improve upon existing flow-based methods, such as the PrimeFlow assay. In certain example embodiments, cells may be cast in droplets containing unpolymerized gel monomer, which can then be cast into single-cell droplets suitable for analysis by flow cytometry. A detection construct comprising a fluorescent detectable label may be cast into the droplet comprising unpolymerized gel monomer upon polymerization of the gel monomer to form a bead within a droplet. Because gel polymerization is through free-radical formation, the fluorescent reporter becomes covalently bound to the gel. The detection construct may be further modified to comprise a linker, such as an amine. A quencher may be added post-gel formation and will bind via the linker to the reporter construct. Thus, the quencher is not bound to the gel and is free to diffuse away when the reporter is cleaved by the CRISPR effector protein. Amplification of signal in droplet may be achieved by coupling the detection construct of a hybridization chain reaction (HCR initiators) amplification. DNA/RNA hybrid hairpins may be incorporated into the gel which may comprise a hairpin loop that has an RNase sensitive domain. By protecting a strand displacement toehold within a hairpin loop that has an RNase sensitive domain, HCR initiators may be selectively deprotected following cleavage of the hairpin loop by the CRISPR effector protein. Following deprotection of HCR initiators via toehold mediated strand displacement, fluorescent HCR monomers may be washed into the gel to enable signal amplification where the initiators are deprotected.

An example of a microfluidic device that may be used in the context of the invention is described in Hou et al. "Direct Dectection and drug-resistance profiling of bacteremias using inertial microfluidics" Lap Chip. 15(10):2297-2307 (2016).

Systems described herein may further be incorporated into wearable medical devices that assess biological samples, such as biological fluids, of a subject outside the clinic setting and report the outcome of the assay remotely to a central server accessible by a medical care professional. The device may include the ability to self-sample blood, such as the devices disclosed in U.S. Patent Application Publication No. 2015/0342509 entitled "Needle-free Blood Draw to Peeters et al., U.S. Patent Application Publication No. 2015/0065821 entitled "Nanoparticle Phoresis" to Andrew Conrad.

In certain example embodiments, the device may comprise individual wells, such as microplate wells. The size of the microplate wells may be the size of standard 6, 24, 96, 384, 1536, 3456, or 9600 sized wells. In certain example embodiments, the elements of the systems described herein may be freeze dried and applied to the surface of the well prior to distribution and use.

The devices disclosed herein may further comprise inlet and outlet ports, or openings, which in turn may be connected to valves, tubes, channels, chambers, and syringes and/or pumps for the introduction and extraction of fluids into and from the device. The devices may be connected to fluid flow actuators that allow directional movement of fluids within the microfluidic device. Example actuators include, but are not limited to, syringe pumps, mechanically actuated recirculating pumps, electroosmotic pumps, bulbs, bellows, diaphragms, or bubbles intended to force movement of fluids. In certain example embodiments, the devices are connected to controllers with programmable valves that work together to move fluids through the device. In certain example embodiments, the devices are connected to the controllers discussed in further detail below. The devices may be connected to flow actuators, controllers, and sample loading devices by tubing that terminates in metal pins for insertion into inlet ports on the device.

As shown herein the elements of the system are stable when freeze dried, therefore embodiments that do not require a supporting device are also contemplated, i.e. the system may be applied to any surface or fluid that will support the reactions disclosed herein and allow for detection of a positive detectable signal from that surface or solution. In addition to freeze-drying, the systems may also be stably stored and utilized in a pelletized form. Polymers useful in forming suitable pelletized forms are known in the art.

In certain embodiments, the CRISPR effector protein is bound to each discrete volume in the device. Each discrete volume may comprise a different guide RNA specific for a different target molecule. In certain embodiments, a sample is exposed to a solid substrate comprising more than one discrete volume each comprising a guide RNA specific for a target molecule. Not being bound by a theory, each guide RNA will capture its target molecule from the sample and the sample does not need to be divided into separate assays. Thus, a valuable sample may be preserved. The effector protein may be a fusion protein comprising an affinity tag. Affinity tags are well known in the art (e.g., HA tag, Myc tag, Flag tag, His tag, biotin). The effector protein may be linked to a biotin molecule and the discrete volumes may comprise streptavidin. In other embodiments, the CRISPR effector protein is bound by an antibody specific for the effector protein. Methods of binding a CRISPR enzyme have been described previously (see, e.g., US20140356867A1).

The devices disclosed herein may also include elements of point of care (POC) devices known in the art for analyzing samples by other methods. See, for example St John and Price, "Existing and Emerging Technologies for Point-of-Care Testing" (Clin Biochem Rev. 2014 August; 35(3): 155-167).

The present invention may be used with a wireless lab-on-chip (LOC) diagnostic sensor system (see e.g., U.S. Pat. No. 9,470,699 "Diagnostic radio frequency identification sensors and applications thereof"). In certain embodiments, the present invention is performed in a LOC controlled by a wireless device (e.g., a cell phone, a personal digital assistant (PDA), a tablet) and results are reported to said device.

Radio frequency identification (RFID) tag systems include an RFID tag that transmits data for reception by an RFID reader (also referred to as an interrogater). In a typical RFID system, individual objects (e.g., store merchandise) are equipped with a relatively small tag that contains a transponder. The transponder has a memory chip that is given a unique electronic product code. The RFID reader emits a signal activating the transponder within the tag through the use of a communication protocol. Accordingly, the RFID reader is capable of reading and writing data to the tag. Additionally, the RFID tag reader processes the data according to the RFID tag system application. Currently, there are passive and active type RFID tags. The passive type RFID tag does not contain an internal power source, but is powered by radio frequency signals received from the RFID reader. Alternatively, the active type RFID tag contains an internal power source that enables the active type RFID tag to possess greater transmission ranges and memory capacity. The use of a passive versus an active tag is dependent upon the particular application.

Lab-on-the chip technology is well described in the scientific literature and consists of multiple microfluidic channels, input or chemical wells. Reactions in wells can be measured using radio frequency identification (RFID) tag technology since conductive leads from RFID electronic chip can be linked directly to each of the test wells. An antenna can be printed or mounted in another layer of the electronic chip or directly on the back of the device. Furthermore, the leads, the antenna and the electronic chip can be embedded into the LOC chip, thereby preventing shorting of the electrodes or electronics. Since LOC allows complex sample separation and analyses, this technology allows LOC tests to be done independently of a complex or expensive reader. Rather, a simple wireless device such as a cell phone or a PDA can be used. In one embodiment, the wireless device also controls the separation and control of the microfluidics channels for more complex LOC analyses. In one embodiment, an LED and other electronic measuring or sensing devices are included in the LOC-RFID chip. Not being bound by a theory, this technology is disposable and allows complex tests that require separation and mixing to be performed outside of a laboratory.

In preferred embodiments, the LOC may be a microfluidic device. The LOC may be a passive chip, wherein the chip is powered and controlled through a wireless device. In certain embodiments, the LOC includes a microfluidic channel for holding reagents and a channel for introducing a sample. In certain embodiments, a signal from the wireless device delivers power to the LOC and activates mixing of the sample and assay reagents. Specifically, in the case of the present invention, the system may include a masking agent, CRISPR effector protein, and guide RNAs specific for a target molecule. Upon activation of the LOC, the microfluidic device may mix the sample and assay reagents. Upon mixing, a sensor detects a signal and transmits the results to the wireless device. In certain embodiments, the unmasking agent is a conductive RNA molecule. The conductive RNA molecule may be attached to the conductive material. Conductive molecules can be conductive nanoparticles, conductive proteins, metal particles that are attached to the protein or latex or other beads that are conductive. In certain embodiments, if DNA or RNA is used then the conductive molecules can be attached directly to the matching DNA or RNA strands. The release of the conductive molecules may be detected across a sensor. The assay may be a one step process.

Since the electrical conductivity of the surface area can be measured precisely, quantitative results are possible on the disposable wireless RFID electro-assays. Furthermore, the test area can be very small, allowing for more tests to be done in a given area and therefore resulting in cost savings. In certain embodiments, separate sensors each associated with a different CRISPR effector protein and guide RNA immobilized to a sensor are used to detect multiple target molecules. Not being bound by a theory, activation of different sensors may be distinguished by the wireless device.

In addition to the conductive methods described herein, other methods may be used that rely on RFID or Bluetooth as the basic low cost communication and power platform for a disposable RFID assay. For example, optical means may be used to assess the presence and level of a given target molecule. In certain embodiments, an optical sensor detects unmasking of a fluorescent masking agent.

In certain embodiments, the device of the present invention may include handheld portable devices for diagnostic reading of an assay (see e.g., Vashist et al., Commercial Smartphone-Based Devices and Smart Applications for Personalized Healthcare Monitoring and Management, *Diagnostics* 2014, 4(3), 104-128; mReader from Mobile Assay; and Holomic Rapid Diagnostic Test Reader).

As noted herein, certain embodiments allow detection via colorimetric change which has certain attendant benefits when embodiments are utilized in POC situations and or in resource poor environments where access to more complex detection equipment to readout the signal may be limited. However, portable embodiments disclosed herein may also be coupled with hand-held spectrophotometers that enable detection of signals outside the visible range. An example of a hand-held spectrophotometer device that may be used in combination with the present invention is described in Das et al. "Ultra-portable, wireless smartphone spectrophotometer for rapid, non-destructive testing of fruit ripeness." Nature Scientific Reports. 2016, 6:32504, DOI: 10.1038/srep32504. Finally, in certain embodiments utilizing quantum dot-based masking constructs, a hand-held UV light, or other suitable device, may be successfully used to detect a signal owing to the near complete quantum yield provided by quantum dots.

Example Methods and Applications

The low cost and adaptability of the assay platform lends itself to a number of applications including (i) general RNA/DNA/protein quantitation, (ii) rapid, multiplexed RNA/DNA and protein expression detection, and (iii) sensitive detection of target nucleic acids, peptides, and proteins in both clinical and environmental samples. Additionally, the systems disclosed herein may be adapted for detection of transcripts within biological settings, such as cells. Given the highly specific nature of the CRISPR effectors described herein, it may be possible to track allelic specific expression of transcripts or disease-associated mutations in live cells.

In certain example embodiments, a single guide RNA specific to a single target is placed in separate volumes. Each volume may then receive a different sample or aliquot of the same sample. In certain example embodiments, multiple guide RNA each to separate target may be placed in a single well such that multiple targets may be screened in a different well. In order to detect multiple guide RNAs in a single volume, in certain example embodiments, multiple effector proteins with different specificities may be used. For example, different orthologs with different sequence specificities may be used. For example, one orthologue may preferentially cut A, while others preferentially cut C, U, or T. Accordingly, guide RNAs that are all, or comprise a substantial portion, of a single nucleotide may be generated, each with a different fluorophore. In this way up to four different targets may be screened in a single individual discrete volume.

As demonstrated herein, the CRISPR effector systems are capable of detecting down to attomolar concentrations of target molecules. See e.g. Examples described below. Due to the sensitivity of said systems, a number of applications that require rapid and sensitive detection may benefit from the embodiments disclosed herein, and are contemplated to be within the scope of the invention. Example assays and applications are described in further detail below.

Microbial Applications

In certain example embodiments, the systems, devices, and methods disclosed herein are directed to detecting the presence of one or more microbial agents in a sample, such as a biological sample obtained from a subject. In certain example embodiments, the microbe may be a *bacterium*, a fungus, a yeast, a protozoan, a parasite, or a virus. Accordingly, the methods disclosed herein can be adapted for use in other methods (or in combination) with other methods that require quick identification of microbe species, monitoring the presence of microbial proteins (antigens), antibodies, antibody genes, detection of certain phenotypes (e.g. bacterial resistance), monitoring of disease progression and/ or outbreak, and antibiotic screening. Because of the rapid and sensitive diagnostic capabilities of the embodiments disclosed here, detection of microbe species type, down to a single nucleotide difference, and the ability to be deployed as a POC device, the embodiments disclosed herein may be used as guide therapeutic regimens, such as selection of the appropriate antibiotic or antiviral. The embodiments disclosed herein may also be used to screen environmental samples (air, water, surfaces, food etc.) for the presence of microbial contamination.

Disclosed is a method to identify microbial species, such as bacterial, viral, fungal, yeast, or parasitic species, or the like. Particular embodiments disclosed herein describe methods and systems that will identify and distinguish microbial species within a single sample, or across multiple samples, allowing for recognition of many different microbes. The present methods allow the detection of pathogens and distinguishing between two or more species of one or more organisms, e.g., bacteria, viruses, yeast, protozoa, and fungi or a combination thereof, in a biological or environmental sample, by detecting the presence of a target nucleic acid sequence in the sample. A positive signal obtained from the sample indicates the presence of the microbe. Multiple microbes can be identified simultaneously using the methods and systems of the invention, by employing the use of more than one effector protein, wherein each effector protein targets a specific microbial target sequence. In this way, a multi-level analysis can be performed for a particular subject in which any number of microbes can be detected at once. In some embodiments, simultaneous detection of multiple microbes may be performed using a set of probes that can identify one or more microbial species.

Multiplex analysis of samples enables large-scale detection of samples, reducing the time and cost of analyses. However, multiplex analyses are often limited by the availability of a biological sample. In accordance with the invention, however, alternatives to multiplex analysis may be performed such that multiple effector proteins can be added to a single sample and each masking construct may be combined with a separate quencher dye. In this case, positive signals may be obtained from each quencher dye separately for multiple detection in a single sample.

Disclosed herein are methods for distinguishing between two or more species of one or more organisms in a sample. The methods are also amenable to detecting one or more species of one or more organisms in a sample.

Microbe Detection

In some embodiments, a method for detecting microbes in samples is provided comprising distributing a sample or set of samples into one or more individual discrete volumes, the individual discrete volumes comprising a CRISPR system as described herein; incubating the sample or set of samples under conditions sufficient to allow binding of the one or more guide RNAs to one or more microbe-specific targets; activating the CRISPR effector protein via binding of the one or more guide RNAs to the one or more target molecules, wherein activating the CRISPR effector protein results in modification of the RNA-based masking construct such that a detectable positive signal is generated; and detecting the detectable positive signal, wherein detection of the detectable positive signal indicates a presence of one or more target molecules in the sample. The one or more target molecules may be mRNA, gDNA (coding or non-coding), trRNA, or RNA comprising a target nucleotide tide sequence that may be used to distinguish two or more microbial species/strains from one another. The guide RNAs may be designed to detect target sequences. The embodiments disclosed herein may also utilize certain steps to improve hybridization between guide RNA and target RNA sequences. Methods for enhancing ribonucleic acid hybridization are disclosed in WO 2015/085194, entitled "Enhanced Methods of Ribonucleic Acid Hybridization" which is incorporated herein by reference. The microbe-specific target may be RNA or DNA or a protein. A DNA method may further comprise the use of DNA primers that introduce an RNA polymerase promoter as described herein. If the target is a protein then the method will utilize aptamers and steps specific to protein detection described herein.

Detection of Single Nucleotide Variants

In some embodiments, one or more identified target sequences may be detected using guide RNAs that are specific for and bind to the target sequence as described herein. The systems and methods of the present invention can distinguish even between single nucleotide polymorphisms present among different microbial species and therefore, use of multiple guide RNAs in accordance with the invention may further expand on or improve the number of target sequences that may be used to distinguish between species. For example, in some embodiments, the one or more guide RNAs may distinguish between microbes at the species, genus, family, order, class, phylum, kingdom, or phenotype, or a combination thereof.

Detection Based on rRNA Sequences

In certain example embodiments, the devices, systems, and methods disclosed herein may be used to distinguish multiple microbial species in a sample. In certain example embodiments, identification may be based on ribosomal RNA sequences, including the 16S, 23S, and 5S subunits. Methods for identifying relevant rRNA sequences are disclosed in U.S. Patent Application Publication No. 2017/0029872. In certain example embodiments, a set of guide RNAs may be designed to distinguish each species by a variable region that is unique to each species or strain. Guide RNAs may also be designed to target RNA genes that distinguish microbes at the genus, family, order, class, phylum, kingdom levels, or a combination thereof. In certain example embodiments where amplification is used, a set of amplification primers may be designed to flanking constant regions of the ribosomal RNA sequence and a guide RNA may be designed to distinguish each species by a variable internal region. In certain example embodiments, the primers and guide RNAs may be designed to conserved and variable regions in the 16S subunit respectfully. Other genes or genomic regions that are uniquely variable across species or a subset of species such as the RecA gene family, RNA polymerase 3 subunit, may be used as well. Other suitable phylogenetic markers, and methods for identifying the same, are discussed for example in Wu et al. arXiv:1307.8690 [q-bio.GN].

In certain example embodiments, a method or diagnostic is designed to screen microbes across multiple phylogenetic and/or phenotypic levels at the same time. For example, the method or diagnostic may comprise the use of multiple CRISPR systems with different guide RNAs. A first set of guide RNAs may distinguish, for example, between mycobacteria, gram positive, and gram negative bacteria. These general classes can be even further subdivided. For example, guide RNAs could be designed and used in the method or diagnostic that distinguish enteric and non-enteric within gram negative bacteria. A second set of guide RNAs can be designed to distinguish microbes at the genus or species level. Thus, a matrix may be produced identifying all mycobacteria, gram positive, gram negative (further divided into enteric and non-enteric) with each genus of species of bacteria identified in a given sample that fall within one of those classes. The foregoing is for example purposes only. Other means for classifying other microbe types are also contemplated and would follow the general structure described above.

Screening for Drug Resistance

In certain example embodiments, the devices, systems and methods disclosed herein may be used to screen for microbial genes of interest, for example antibiotic and/or antiviral resistance genes. Guide RNAs may be designed to distinguish between known genes of interest. Samples, including clinical samples, may then be screened using the embodiments disclosed herein for detection of such genes. The ability to screen for drug resistance at POC would have tremendous benefit in selecting an appropriate treatment regimen. In certain example embodiments, the antibiotic resistance genes are carbapenemases including KPC, NDM1, CTX-M15, OXA-48. Other antibiotic resistance genes are known and may be found for example in the Comprehensive Antibiotic Resistance Database (Jia et al. "CARD 2017: expansion and model-centric curation of the Comprehensive Antibiotic Resistance Database." Nucleic Acids Research, 45, D566-573).

Ribavirin is an effective antiviral that hits a number of RNA viruses. Several clinically important viruses have evolved ribavirin resistance, including Foot and Mouth Disease Virus doi:10.1128/JVI.03594-13; polio virus (Pfeifer and Kirkegaard. PNAS, 100(12):7289-7294, 2003); and hepatitis C virus (Pfeiffer and Kirkegaard, J. Virol. 79(4): 2346-2355, 2005). A number of other persistent RNA viruses, such as hepatitis and HIV, have evolved resistance to existing antiviral drugs: hepatitis B virus (lamivudine, tenofovir, entecavir) doi:10/1002/hep22900; hepatitis C virus (telaprevir, BILN2061, ITMN-191, SCh6, boceprevir, AG-021541, ACH-806) doi:10.1002/hep.22549; and HIV (many drug resistance mutations) hivb.standford.edu. The embodiments disclosed herein may be used to detect such variants among others.

Aside from drug resistance, there are a number of clinically relevant mutations that could be detected with the embodiments disclosed herein, such as persistent versus acute infection in LCMV (doi: 10.1073/pnas. 1019304108), and increased infectivity of Ebola (Diehl et al. Cell. 2016, 167(4):1088-1098.

As described herein elsewhere, closely related microbial species (e.g. having only a single nucleotide difference in a given target sequence) may be distinguished by introduction of a synthetic mismatch in the gRNA.

Set Cover Approaches

In particular embodiments, a set of guide RNAs is designed that can identify, for example, all microbial species within a defined set of microbes. Such methods are described in certain example embodiments, the methods for generating guide RNAs as described herein may be compared to methods disclosed in WO 2017/040316, incorporated herein by reference. As described in WO 2017040316, a set cover solution may identify the minimal number of target sequences, probes, or guide RNAs needed to cover an entire target sequence or set of target sequences, e.g. a set of genomic sequences. Set cover approaches have been used previously to identify primers and/or microarray probes, typically in the 20 to 50 base pair range. See, e.g. Pearson et al., cs.virginia.edu/~robins/papers/primers_dam11_final.pdf., Jabado et al. Nucleic Acids Res. 2006 34(22):6605-11, Jabado et al. Nucleic Acids Res. 2008, 36(1):e3 doi 10.1093/nar/gkm1106, Duitama et al. Nucleic Acids Res. 2009, 37(8):2483-2492, Phillippy et al. BMC Bioinformatics. 2009, 10:293 doi:10.1186/1471-2105-10-293. However, such approaches generally involved treating each primer/probe as k-mers and searching for exact matches or allowing for inexact matches using suffix arrays. In addition, the methods generally take a binary approach to detecting hybridization by selecting primers or probes such that each input sequence only needs to be bound by one primer or probe and the position of this binding along the sequence is irrelevant. Alternative methods may divide a target genome into pre-defined windows and effectively treat each window as a separate input sequence under the binary approach—i.e. they determine whether a given probe or guide RNA binds within each window and require that all of the windows be bound by the state of some probe or guide RNA. Effectively, these approaches treat each element of the "universe" in the set cover problem as being either an entire input sequence or a pre-defined window of an input sequence, and each element is considered "covered" if the start of a probe or guide RNA binds within the element. These approaches limit the fluidity to which different probe or guide RNA designs are allowed to cover a given target sequence.

In contrast, the embodiments disclosed herein are directed to detecting longer probe or guide RNA lengths, for example, in the range of 70 bp to 200 bp that are suitable for hybrid selection sequencing. In addition, the methods disclosed herein may be applied to take a pan-target sequence approach capable of defining a probe or guide RNA sets that can identify and facilitate the detection sequencing of all species and/or strain sequences in a large and/or variable target sequence set. For example, the methods disclosed herein may be used to identify all variants of a given virus, or multiple different viruses in a single assay. Further, the method disclosed herein treats each element of the "universe" in the set cover problem as being a nucleotide of a target sequence, and each element is considered "covered" as long as a probe or guide RNA binds to some segment of a target genome that includes the element. These types of set cover methods may be used instead of the binary approach of previous methods, the methods disclosed herein better model how a probe or guide RNA may hybridize to a target sequence. Rather than only asking if a given guide RNA sequence does or does not bind to a given window, such approaches may be used to detect a hybridization pattern—i.e. where a given probe or guide RNA binds to a target sequence or target sequences—and then determines from those hybridization patterns the minimum number of probes or guide RNAs needed to cover the set of target sequences to a degree sufficient to enable both enrichment from a sample and sequencing of any and all target sequences. These hybridization patterns may be determined by defining certain parameters that minimize a loss function, thereby enabling identification of minimal probe or guide RNA sets in a way that allows parameters to vary for each species, e.g. to reflect the diversity of each species, as well as in a computationally efficient manner that cannot be achieved using a straightforward application of a set cover solution, such as those previously applied in the probe or guide RNA design context.

The ability to detect multiple transcript abundances may allow for the generation of unique microbial signatures indicative of a particular phenotype. Various machine learning techniques may be used to derive the gene signatures. Accordingly, the guide RNAs of the CRISPR systems may be used to identify and/or quantitate relative levels of biomarkers defined by the gene signature in order to detect certain phenotypes. In certain example embodiments, the gene signature indicates susceptibility to an antibiotic, resistance to an antibiotic, or a combination thereof.

In one aspect of the invention, a method comprises detecting one or more pathogens. In this manner, differentiation between infection of a subject by individual microbes may be obtained. In some embodiments, such differentiation may enable detection or diagnosis by a clinician of specific diseases, for example, different variants of a disease. Preferably the pathogen sequence is a genome of the pathogen or a fragment thereof. The method further may comprise determining the evolution of the pathogen. Determining the evolution of the pathogen may comprise identification of pathogen mutations, e.g. nucleotide deletion, nucleotide insertion, nucleotide substitution. Amongst the latter, there are non-synonymous, synonymous, and noncoding substitutions. Mutations are more frequently non-synonymous during an outbreak. The method may further comprise determining the substitution rate between two pathogen sequences analyzed as described above. Whether the mutations are deleterious or even adaptive would require functional analysis, however, the rate of non-synonymous mutations suggests that continued progression of this epidemic could afford an opportunity for pathogen adaptation, underscoring the need for rapid containment. Thus, the method may further comprise assessing the risk of viral adaptation, wherein the number of non-synonymous mutations is determined (Gire, et al., Science 345, 1369, 2014).

Monitoring Microbe Outbreaks

In some embodiments, a CRISPR system or methods of use thereof as described herein may be used to determine the evolution of a pathogen outbreak. The method may comprise detecting one or more target sequences from a plurality of samples from one or more subjects, wherein the target sequence is a sequence from a microbe causing the outbreaks. Such a method may further comprise determining a pattern of pathogen transmission, or a mechanism involved in a disease outbreak caused by a pathogen.

The pattern of pathogen transmission may comprise continued new transmissions from the natural reservoir of the pathogen or subject-to-subject transmissions (e.g. human-to-human transmission) following a single transmission from the natural reservoir or a mixture of both. In one embodiment, the pathogen transmission may be bacterial or viral transmission, in such case, the target sequence is preferably a microbial genome or fragments thereof. In one embodiment, the pattern of the pathogen transmission is the early pattern of the pathogen transmission, i.e. at the beginning of the pathogen outbreak. Determining the pattern of the pathogen transmission at the beginning of the outbreak increases the likelihood of stopping the outbreak at the earliest possible time thereby reducing the possibility of local and international dissemination.

Determining the pattern of the pathogen transmission may comprise detecting a pathogen sequence according to the methods described herein. Determining the pattern of the pathogen transmission may further comprise detecting shared intra-host variations of the pathogen sequence between the subjects and determining whether the shared intra-host variations show temporal patterns. Patterns in observed intrahost and interhost variation provide important insight about transmission and epidemiology (Gire, et al., 2014).

Detection of shared intra-host variations between the subjects that show temporal patterns is an indication of transmission links between subjects (in particular between humans) because it can be explained by subject infection from multiple sources (superinfection), sample contamination recurring mutations (with or without balancing selection to reinforce mutations), or co-transmission of slightly divergent viruses that arose by mutation earlier in the transmission chain (Park, et al., Cell 161(7):1516-1526, 2015). Detection of shared intra-host variations between subjects may comprise detection of intra-host variants located at common single nucleotide polymorphism (SNP) positions. Positive detection of intra-host variants located at common (SNP) positions is indicative of superinfection and contamination as primary explanations for the intra-host variants. Superinfection and contamination can be parted on the basis of SNP frequency appearing as inter-host variants (Park, et al., 2015). Otherwise superinfection and contamination can be ruled out. In this latter case, detection of shared intra-host variations between subjects may further comprise assessing the frequencies of synonymous and nonsynonymous variants and comparing the frequency of synonymous and nonsynonymous variants to one another. A nonsynonymous mutation is a mutation that alters the amino acid of the protein, likely resulting in a biological change in the microbe that is subject to natural selection. Synonymous substitution does not alter an amino acid sequence. Equal frequency of synonymous and nonsynonymous variants is indicative of the intra-host variants evolving neutrally. If frequencies of synonymous and nonsynonymous variants are divergent, the intra-host variants are likely to be maintained by balancing selection. If frequencies of synonymous and nonsynonymous variants are low, this is indicative of recurrent mutation. If frequencies of synonymous and nonsynonymous variants are high, this is indicative of co-transmission (Park, et al., 2015).

Like Ebola virus, Lassa virus (LASV) can cause hemorrhagic fever with high case fatality rates. Andersen et al. generated a genomic catalog of almost 200 LASV sequences from clinical and rodent reservoir samples (Andersen, et al., Cell Volume 162, Issue 4, p 738-750, 13 Aug. 2015). Andersen et al. show that whereas the 2013-2015 EVD epidemic is fueled by human-to-human transmissions, LASV infections mainly result from reservoir-to-human infections. Andersen et al. elucidated the spread of LASV across West Africa and show that this migration was accompanied by changes in LASV genome abundance, fatality rates, codon adaptation, and translational efficiency. The method may further comprise phylogenetically comparing a first pathogen sequence to a second pathogen sequence, and determining whether there is a phylogenetic link between the first and second pathogen sequences. The second pathogen sequence may be an earlier reference sequence. If there is a phylogenetic link, the method may further comprise rooting the phylogeny of the first pathogen sequence to the second pathogen sequence. Thus, it is possible to construct the lineage of the first pathogen sequence (Park, et al., 2015).

The method may further comprise determining whether the mutations are deleterious or adaptive. Deleterious mutations are indicative of transmission-impaired viruses and dead-end infections, and are thus normally only present in an individual subject. Mutations unique to one individual subject are those that occur on the external branches of the phylogenetic tree, whereas internal branch mutations are those present in multiple samples (i.e. in multiple subjects). Higher rate of nonsynonymous substitution is a characteristic of external branches of the phylogenetic tree (Park, et al., 2015).

In internal branches of the phylogenetic tree, selection has had more opportunity to filter out deleterious mutants. Internal branches, by definition, have produced multiple descendent lineages and are thus less likely to include mutations with fitness costs. Thus, lower rate of nonsynonymous substitution is indicative of internal branches (Park, et al., 2015).

Synonymous mutations, which likely have less impact on fitness, occurred at more comparable frequencies on internal and external branches (Park, et al., 2015).

By analyzing the sequenced target sequence, such as viral genomes, it is possible to discover the mechanisms responsible for the severity of the epidemic episode such as during the 2014 Ebola outbreak. For example, Gire et al. made a phylogenetic comparison of the genomes of the 2014 outbreak to all 20 genomes from earlier outbreaks, which suggests that the 2014 West African virus likely spread from central Africa within the past decade. Rooting the phylogeny using divergence from other ebolavirus genomes was problematic. However, rooting the tree on the oldest outbreak revealed a strong correlation between sample date and root-to-tip distance, with a substitution rate of $8 \times 10^{-4}$ per site per year. This suggests that the lineages of the three most recent outbreaks all diverged from a common ancestor at roughly the same time, around 2004, which supports the hypothesis that each outbreak represents an independent zoonotic event from the same genetically diverse viral population in its natural reservoir. They also found out that the 2014 EBOV outbreak might be caused by a single transmission from the natural reservoir, followed by human-to-human transmission during the outbreak. Their results also suggested that the epidemic episode in Sierra Leone might stem from the introduction of two genetically distinct viruses from Guinea around the same time (Gire, et al., 2014).

It has been also possible to determine how the Lassa virus spread out from its origin point, in particular thanks to human-to-human transmission and even retrace the history of this spread 400 years back (Andersen, et al., Cell 162(4): 738-50, 2015).

In relation to the work needed during the 2013-2015 EBOV outbreak and the difficulties encountered by the medical staff at the site of the outbreak, and more generally, the method of the invention makes it possible to carry out sequencing using fewer selected probes such that sequencing can be accelerated, thus shortening the time needed from sample taking to results procurement. Further, kits and systems can be designed to be usable on the field so that diagnostics of a patient can be readily performed without the need to send or ship samples to another part of the country or the world.

In any method described above, sequencing the target sequence or fragment thereof may use any of the sequencing processes described above. Further, sequencing the target sequence or fragment thereof may be a near-real-time sequencing. Sequencing the target sequence or fragment thereof may be carried out according to previously described methods (Experimental Procedures: Matranga et al., 2014; and Gire, et al., 2014). Sequencing the target sequence or fragment thereof may comprise parallel sequencing of a plurality of target sequences. Sequencing the target sequence or fragment thereof may comprise Illumina sequencing.

Analyzing the target sequence or fragment thereof that hybridizes to one or more of the selected probes may be an identifying analysis, wherein hybridization of a selected probe to the target sequence or a fragment thereof indicates the presence of the target sequence within the sample.

Currently, primary diagnostics are based on the symptoms a patient has. However, various diseases may share identical symptoms so that diagnostics rely much on statistics. For example, malaria triggers flu-like symptoms: headache, fever, shivering, joint pain, vomiting, hemolytic anemia, jaundice, hemoglobin in the urine, retinal damage, and convulsions. These symptoms are also common for septicemia, gastroenteritis, and viral diseases. Amongst the latter, Ebola hemorrhagic fever has the following symptoms: fever, sore throat, muscular pain, headaches, vomiting, diarrhea, rash, decreased function of the liver and kidneys, internal and external hemorrhage.

When a patient is presented to a medical unit, for example in tropical Africa, basic diagnostics will conclude to malaria because statistically, malaria is the most probable disease within that region of Africa. The patient is consequently treated for malaria although the patient might not actually have contracted the disease and the patient ends up not being correctly treated. This lack of correct treatment can be life-threatening especially when the disease the patient contracted presents a rapid evolution. It might be too late before the medical staff realizes that the treatment given to the patient is ineffective and comes to the correct diagnostics and administers the adequate treatment to the patient.

The method of the invention provides a solution to this situation. Indeed, because the number of guide RNAs can be dramatically reduced, this makes it possible to provide on a single chip, selected probes divided into groups, each group being specific to one disease, such that a plurality of diseases, e.g. viral infection, can be diagnosed at the same time. Thanks to the invention, more than 3 diseases can be diagnosed on a single chip, preferably more than 4, 5, 6, 7, 8, 9, 10, 11, 12, 13, 14, 15, 16, 17, 18, 19, 20 diseases at the same time, preferably the diseases that most commonly occur within the population of a given geographical area. Since each group of selected probes is specific to one of the diagnosed diseases, a more accurate diagnosis can be performed, thus diminishing the risk of administering the wrong treatment to the patient.

In other cases, a disease such as a viral infection may occur without any symptoms, or had caused symptoms but they faded out before the patient is presented to the medical staff. In such cases, either the patient does not seek any medical assistance or the diagnosis is complicated due to the absence of symptoms on the day of the presentation.

The present invention may also be used in concert with other methods of diagnosing disease, identifying pathogens and optimizing treatment based upon detection of nucleic acids, such as mRNA in crude, non-purified samples.

The method of the invention also provides a powerful tool to address this situation. Indeed, since a plurality of groups of selected guide RNAs, each group being specific to one of the most common diseases that occur within the population of the given area, are comprised within a single diagnostic, the medical staff only need to contact a biological sample taken from the patient with the chip. Reading the chip reveals the diseases the patient has contracted.

In some cases, the patient is presented to the medical staff for diagnosis of particular symptoms. The method of the invention makes it possible not only to identify which disease causes these symptoms but at the same time determine whether the patient suffers from another disease he was not aware of.

This information might be of utmost importance when searching for the mechanisms of an outbreak. Indeed, groups of patients with identical viruses also show temporal patterns suggesting subject-to-subject transmission links.

Screening Microbial Genetic Perturbations

In certain example embodiments, the CRISPR systems disclosed herein may be used to screen microbial genetic perturbations. Such methods may be useful, for example to map out microbial pathways and functional networks. Microbial cells may be genetically modified and then screened under different experimental conditions. As described above, the embodiments disclosed herein can screen for multiple target molecules in a single sample, or a single target in a single individual discrete volume in a multiplex fashion. Genetically modified microbes may be modified to include a nucleic acid barcode sequence that identifies the particular genetic modification carried by a particular microbial cell or population of microbial cells. A barcode is a short sequence of nucleotides (for example, DNA, RNA, or combinations thereof) that is used as an identifier. A nucleic acid barcode may have a length of 4-100 nucleotides and be either single or double-stranded. Methods for identifying cells with barcodes are known in the art. Accordingly, guide RNAs of the CRISPR effector systems described herein may be used to detect the barcode. Detection of the positive detectable signal indicates the presence of a particular genetic modification in the sample. The methods disclosed herein may be combined with other methods for detecting complimentary genotype or phenotypic readouts indicating the effect of the genetic modification under the experimental conditions tested. Genetic modifications to be screened may include, but are not limited to a gene knock-in, a gene knock-out, inversions, translocations, transpositions, or one or more nucleotide insertions, deletions, substitutions, mutations, or addition of nucleic acids encoding an epitope with a functional consequence such as altering protein stability or detection. In a similar fashion, the methods described herein may be used in synthetic biology application to screen the functionality of specific arrangements of gene regulatory elements and gene expression modules.

In certain example embodiments, the methods may be used to screen hypomorphs. Generation of hypomorphs and their use in identifying key bacterial functional genes and identification of new antibiotic therapeutics as disclosed in PCT/US2016/060730 entitled "Multiplex High-Resolution Detection of Micro-organism Strains, Related Kits, Diagnostic Methods and Screening Assays" filed Nov. 4, 2016, which is incorporated herein by reference.

The different experimental conditions may comprise exposure of the microbial cells to different chemical agents, combinations of chemical agents, different concentrations of chemical agents or combinations of chemical agents, different durations of exposure to chemical agents or combinations of chemical agents, different physical parameters, or both. In certain example embodiments, the chemical agent is an antibiotic or antiviral. Different physical parameters to be screened may include different temperatures, atmospheric pressures, different atmospheric and non-atmospheric gas concentrations, different pH levels, different culture media compositions, or a combination thereof.

Screening Environmental Samples

The methods disclosed herein may also be used to screen environmental samples for contaminants by detecting the presence of target nucleic acid or polypeptides. For example, in some embodiments, the invention provides a method of detecting microbes, comprising: exposing a CRISPR system as described herein to a sample; activating an RNA effector protein via binding of one or more guide RNAs to one or more microbe-specific target RNAs or one or more trigger RNAs such that a detectable positive signal is produced. The positive signal can be detected and is indicative of the presence of one or more microbes in the sample. In some embodiments, the CRISPR system may be on a substrate as described herein, and the substrate may be exposed to the sample. In other embodiments, the same CRISPR system, and/or a different CRISPR system may be applied to multiple discrete locations on the substrate. In further embodiments, the different CRISPR system may detect a different microbe at each location. As described in further detail above, a substrate may be a flexible materials substrate, for example, including, but not limited to, a paper substrate, a fabric substrate, or a flexible polymer-based substrate.

In accordance with the invention, the substrate may be exposed to the sample passively, by temporarily immersing the substrate in a fluid to be sampled, by applying a fluid to be tested to the substrate, or by contacting a surface to be tested with the substrate. Any means of introducing the sample to the substrate may be used as appropriate.

As described herein, a sample for use with the invention may be a biological or environmental sample, such as a food sample (fresh fruits or vegetables, meats), a beverage sample, a paper surface, a fabric surface, a metal surface, a wood surface, a plastic surface, a soil sample, a freshwater sample, a wastewater sample, a saline water sample, exposure to atmospheric air or other gas sample, or a combination thereof. For example, household/commercial/industrial surfaces made of any materials including, but not limited to, metal, wood, plastic, rubber, or the like, may be swabbed and tested for contaminants. Soil samples may be tested for the presence of pathogenic bacteria or parasites, or other microbes, both for environmental purposes and/or for human, animal, or plant disease testing. Water samples such as freshwater samples, wastewater samples, or saline water samples can be evaluated for cleanliness and safety, and/or potability, to detect the presence of, for example, *Cryptosporidium parvum, Giardia lamblia*, or other microbial contamination. In further embodiments, a biological sample may be obtained from a source including, but not limited to, a tissue sample, saliva, blood, plasma, sera, stool, urine, sputum, mucous, lymph, synovial fluid, cerebrospinal fluid, ascites, pleural effusion, seroma, pus, or swab of skin or a mucosal membrane surface. In some particular embodiments, an environmental sample or biological samples may be crude samples and/or the one or more target molecules may not be purified or amplified from the sample prior to application of the method. Identification of microbes may be useful and/or needed for any number of applications, and thus any type of sample from any source deemed appropriate by one of skill in the art may be used in accordance with the invention.

In some embodiments, checking for food contamination by bacteria, such as *E. coli*, in restaurants or other food providers; food surfaces; testing water for pathogens like *Salmonella, Campylobacter*, or *E. coli*; also checking food quality for manufacturers and regulators to determine the purity of meat sources; identifying air contamination with pathogens such as *legionella*; checking whether beer is contaminated or spoiled by pathogens like *Pediococcus* and *Lactobacillus*; contamination of pasteurized or un-pasteurized cheese by bacteria or fungi during manufacture.

A microbe in accordance with the invention may be a pathogenic microbe or a microbe that results in food or consumable product spoilage. A pathogenic microbe may be pathogenic or otherwise undesirable to humans, animals, or plants. For human or animal purposes, a microbe may cause a disease or result in illness. Animal or veterinary applications of the present invention may identify animals infected with a microbe. For example, the methods and systems of the invention may identify companion animals with pathogens including, but not limited to, kennel cough, rabies virus, and heartworms. In other embodiments, the methods and systems of the invention may be used for parentage testing for breeding purposes. A plant microbe may result in harm or disease to a plant, reduction in yield, or alter traits such as color, taste, consistency, odor. For food or consumable contamination purposes, a microbe may adversely affect the taste, odor, color, consistency or other commercial properties of the food or consumable product. In certain example embodiments, the microbe is a bacterial species. The bacteria may be a psychrotroph, a coliform, a lactic acid *bacterium*, or a spore-forming *bacterium*. In certain example embodiments, the bacteria may be any bacterial species that causes disease or illness, or otherwise results in an unwanted product or trait. Bacteria in accordance with the invention may be pathogenic to humans, animals, or plants.

Sample Types

Appropriate samples for use in the methods disclosed herein include any conventional biological sample obtained from an organism or a part thereof, such as a plant, animal, bacteria, and the like. In particular embodiments, the biological sample is obtained from an animal subject, such as a human subject. A biological sample is any solid or fluid sample obtained from, excreted by or secreted by any living organism, including, without limitation, single celled organisms, such as bacteria, yeast, protozoans, and amoebas among others, multicellular organisms (such as plants or animals, including samples from a healthy or apparently healthy human subject or a human patient affected by a condition or disease to be diagnosed or investigated, such as an infection with a pathogenic microorganism, such as a pathogenic *bacterium* or virus). For example, a biological sample can be a biological fluid obtained from, for example, blood, plasma, serum, urine, stool, sputum, mucous, lymph fluid, synovial fluid, bile, ascites, pleural effusion, seroma, saliva, cerebrospinal fluid, aqueous or vitreous humor, or any bodily secretion, a transudate, an exudate (for example, fluid obtained from an abscess or any other site of infection or inflammation), or fluid obtained from a joint (for example, a normal joint or a joint affected by disease, such as rheumatoid arthritis, osteoarthritis, gout or septic arthritis), or a swab of skin or mucosal membrane surface.

A sample can also be a sample obtained from any organ or tissue (including a biopsy or autopsy specimen, such as a tumor biopsy) or can include a cell (whether a primary cell or cultured cell) or medium conditioned by any cell, tissue or organ. Exemplary samples include, without limitation, cells, cell lysates, blood smears, cytocentrifuge preparations, cytology smears, bodily fluids (e.g., blood, plasma, serum, saliva, sputum, urine, bronchoalveolar lavage, semen, etc.), tissue biopsies (e.g., tumor biopsies), fine-needle aspirates, and/or tissue sections (e.g., cryostat tissue sections and/or paraffin-embedded tissue sections). In other examples, the sample includes circulating tumor cells (which can be identified by cell surface markers). In particular examples, samples are used directly (e.g., fresh or frozen), or can be manipulated prior to use, for example, by fixation (e.g., using formalin) and/or embedding in wax (such as formalin-fixed paraffin-embedded (FFPE) tissue samples). It will be appreciated that any method of obtaining tissue from a subject can be utilized, and that the selection of the method used will depend upon various factors such as the type of tissue, age of the subject, or procedures available to the practitioner. Standard techniques for acquisition of such samples are available in the art. See, for example Schluger et al., *J. Exp. Med.* 176:1327-33 (1992); Bigby et al., *Am. Rev. Respir. Dis.* 133:515-18 (1986); Kovacs et al., NEJM 318:589-93 (1988); and Ognibene et al., *Am. Rev. Respir. Dis.* 129:929-32 (1984).

In other embodiments, a sample may be an environmental sample, such as water, soil, or a surface such as industrial or medical surface. In some embodiments, methods such as disclosed in US patent publication No. 2013/0190196 may be applied for detection of nucleic acid signatures, specifically RNA levels, directly from crude cellular samples with a high degree of sensitivity and specificity. Sequences specific to each pathogen of interest may be identified or selected by comparing the coding sequences from the pathogen of interest to all coding sequences in other organisms by BLAST software.

Several embodiments of the present disclosure involve the use of procedures and approaches known in the art to successfully fractionate clinical blood samples. See, e.g. the procedure described in Han Wei Hou et al., *Microfluidic Devices for Blood Fractionation*, Micromachines 2011, 2, 319-343; Ali Asgar S. Bhagat et al., *Dean Flow Fractionation (DFF) Isolation of Circulating Tumor Cells (CTCs) from Blood*, 15$^{th}$ International Conference on Miniaturized Systems for Chemistry and Life Sciences, Oct. 2-6, 2011, Seattle, WA; and International Patent Publication No. WO2011109762, the disclosures of which are herein incorporated by reference in their entirety. Blood samples are commonly expanded in culture to increase sample size for testing purposes. In some embodiments of the present invention, blood or other biological samples may be used in methods as described herein without the need for expansion in culture.

Further, several embodiments of the present disclosure involve the use of procedures and approaches known in the art to successfully isolate pathogens from whole blood using spiral microchannel, as described in Han Wei Hou et al., Pathogen Isolation from Whole Blood Using Spiral Microchannel, Case No. 15995JR, Massachusetts Institute of Technology, manuscript in preparation, the disclosure of which is herein incorporated by reference in its entirety.

Owing to the increased sensitivity of the embodiments disclosed herein, in certain example embodiments, the assays and methods may be run on crude samples or samples where the target molecules to be detected are not further fractionated or purified from the sample.

Example Microbes

The embodiment disclosed herein may be used to detect a number of different microbes. The term microbe as used herein includes bacteria, fungi, protozoa, parasites and viruses.

Bacteria

The following provides an example list of the types of microbes that might be detected using the embodiments disclosed herein. In certain example embodiments, the microbe is a *bacterium*. Examples of bacteria that can be detected in accordance with the disclosed methods include without limitation any one or more of (or any combination of) *Acinetobacter baumanii, Actinobacillus* sp., *Actinomycetes, Actinomyces* sp. (such as *Actinomyces israelii* and *Actinomyces naeslundii*), *Aeromonas* sp. (such as *Aeromonas hydrophila, Aeromonas veronii* biovar *sobria* (*Aeromonas sobria*), and *Aeromonas caviae*), *Anaplasma phagocytophilum, Anaplasma* marginale *Alcaligenes xylosoxidans, Acinetobacter baumanii, Actinobacillus actinomycetemcomitans, Bacillus* sp. (such as *Bacillus anthracis, Bacillus cereus, Bacillus subtilis, Bacillus thuringiensis*, and *Bacillus stearothermophilus*), *Bacteroides* sp. (such as *Bacteroides fragilis*), *Bartonella* sp. (such as *Bartonella bacilliformis* and *Bartonella henselae, Bifidobacterium* sp., *Bordetella* sp. (such as *Bordetella pertussis, Bordetella parapertussis*, and *Bordetella bronchiseptica*), *Borrelia* sp. (such as *Borrelia recurrentis*, and *Borrelia burgdorferi*), *Brucella* sp. (such as *Brucella abortus, Brucella canis, Brucella melintensis* and *Brucella suis*), *Burkholderia* sp. (such as *Burkholderia pseudomallei* and *Burkholderia cepacia*), *Campylobacter* sp. (such as *Campylobacter jejuni, Campylobacter coli, Campylobacter lari* and *Campylobacter fetus*), *Capnocytophaga* sp., *Cardiobacterium hominis, Chlamydia trachomatis, Chlamydophila pneumoniae, Chlamydophila psittaci, Citrobacter* sp. *Coxiella burnetii, Corynebacterium* sp. (such as, *Corynebacterium diphtheriae, Corynebacterium jeikeum* and *Corynebacterium*), *Clostridium* sp. (such as *Clostridium perfringens, Clostridium difficile, Clostridium botulinum* and *Clostridium tetani*), *Eikenella corrodens, Enterobacter* sp. (such as *Enterobacter aerogenes, Enterobacter agglomerans, Enterobacter cloacae* and *Escherichia coli*, including opportunistic *Escherichia coli*, such as enterotoxigenic *E. coli*, enteroinvasive *E. coli*, enteropathogenic *E. coli*, enterohemorrhagic *E. coli*, enteroaggregative *E. coli* and uropathogenic *E. coli*) *Enterococcus* sp. (such as *Enterococcus faecalis* and *Enterococcus faecium*) *Ehrlichia* sp. (such as *Ehrlichia chafeensia* and *Ehrlichia canis*), *Epidermophyton floccosum, Erysipelothrix rhusiopathiae, Eubacterium* sp., *Francisella tularensis, Fusobacterium nucleatum, Gardnerella vaginalis, Gemella morbillorum, Haemophilus* sp. (such as *Haemophilus influenzae, Haemophilus ducreyi, Haemophilus aegyptius, Haemophilus parainfluenzae, Haemophilus haemolyticus* and *Haemophilus parahaemolyticus, Helicobacter* sp. (such as *Helicobacter pylori, Helicobacter cinaedi* and *Helicobacter fennelliae*), *Kingella kingii, Klebsiella* sp. (such as *Klebsiella pneumoniae, Klebsiella granulomatis* and *Klebsiella oxytoca*), *Lactobacillus* sp., *Listeria monocytogenes, Leptospira interrogans*, Legionella pneumophila, *Leptospira interrogans, Peptostreptococcus* sp., *Mannheimia hemolytica, Microsporum canis, Moraxella catarrhalis, Morganella* sp., *Mobiluncus* sp., *Micrococcus* sp., *Mycobacterium* sp. (such as *Mycobacterium leprae, Mycobacterium tuberculosis, Mycobacterium paratuberculosis, Mycobacterium intracellulare, Mycobacterium avium, Mycobacterium bovis*, and *Mycobacterium marinum*), *Mycoplasm* sp. (such as *Mycoplasma pneumoniae, Mycoplasma hominis*, and *Mycoplasma genitalium*), *Nocardia* sp. (such as *Nocardia asteroides, Nocardia cyriacigeorgica* and *Nocardia brasiliensis*), *Neisseria* sp. (such as *Neisseria gonorrhoeae* and *Neisseria meningitidis*), *Pasteurella multocida, Pityrosporum orbiculare (Malassezia furfur), Plesiomonas shigelloides. Prevotella* sp., *Porphyromonas* sp., *Prevotella melaninogenica, Proteus* sp. (such as *Proteus vulgaris* and *Proteus mirabilis*), *Providencia* sp. (such as *Providencia alcalifaciens, Providencia rettgeri* and *Providencia stuartii*), *Pseudomonas aeruginosa, Propionibacterium acnes, Rhodococcus equi, Rickettsia* sp. (such as *Rickettsia rickettsii, Rickettsia akari* and *Rickettsia prowazekii, Orientia tsutsugamushi* (formerly. *Rickettsia tsutsugamushi*) and *Rickettsia typhi*), *Rhodococcus* sp., *Serratia marcescens, Stenotrophomonas maltophilia, Salmonella* sp. (such as *Salmonella enterica, Salmonella typhi, Salmonella paratyphi, Salmonella enteritidis, Salmonella cholerasuis* and *Salmonella typhimurium*), *Serratia* sp. (such as *Serratia marcesans* and *Serratia liquifaciens*), *Shigella* sp. (such as *Shigella dysenteriae, Shigella flexneri, Shigella boydii* and *Shigella sonnei*), *Staphylococcus* sp. (such as *Staphylococcus aureus, Staphylococcus epidermidis, Staphylococcus hemolyticus, Staphylococcus saprophyticus*), *Streptococcus* sp. (such as *Streptococcus pneumoniae* (for example chloramphenicol-resistant serotype 4 *Streptococcus pneumoniae*, spectinomycin-resistant serotype 6B *Streptococcus pneumoniae*, streptomycin-resistant serotype 9V *Streptococcus pneumoniae*, erythromycin-resistant serotype 14 *Streptococcus pneumoniae*, optochin-resistant serotype 14 *Streptococcus pneumoniae*, rifampicin-resistant serotype 18C *Streptococcus pneumoniae*, tetracycline-resistant serotype 19F *Streptococcus pneumoniae*, penicillin-resistant serotype 19F *Streptococcus pneumoniae*, and trimethoprim-resistant serotype 23F *Streptococcus pneumoniae*, chloramphenicol-resistant serotype 4 *Streptococcus pneumoniae*, spectinomycin-resistant serotype 6B *Streptococcus pneumoniae*, streptomycin-resistant serotype 9V *Streptococcus pneumoniae*, optochin-resistant serotype 14 *Streptococcus pneumoniae*, rifampicin-resistant serotype 18C *Streptococcus pneumoniae*, penicillin-resistant serotype 19F *Streptococcus pneumoniae*, or trimethoprim-resistant serotype 23F *Streptococcus pneumoniae*), *Streptococcus agalactiae*, *Streptococcus mutans*, *Streptococcus pyogenes*, Group A streptococci, *Streptococcus pyogenes*, Group B streptococci, *Streptococcus agalactiae*, Group C streptococci, *Streptococcus anginosus*, *Streptococcus equismilis*, Group D streptococci, *Streptococcus bovis*, Group F streptococci, and *Streptococcus anginosus* Group G streptococci), *Spirillum minus*, *Streptobacillus moniliformi*, *Treponema* sp. such as *Treponema carateum*, *Treponema petenue*, *Treponema pallidum* and *Treponema endemicum*, *Trichophyton rubrum*, *T mentagrophytes*, *Tropheryma whippelii*, *Ureaplasma urealyticum*, *Veillonella* sp., *Vibrio* sp. (such as *Vibrio cholerae*, *Vibrio parahemolyticus*, *Vibrio vulnificus*, *Vibrio parahaemolyticus*, *Vibrio vulnificus*, *Vibrio alginolyticus*, *Vibrio mimicus*, *Vibrio hollisae*, *Vibrio fluvialis*, *Vibrio metchnikovii*, *Vibrio damsela* and *Vibrio furnisii*), *Yersinia* sp. (such as *Yersinia enterocolitica*, *Yersinia pestis*, and *Yersinia pseudotuberculosis*) and *Xanthomonas maltophilia* among others.

Fungi

In certain example embodiments, the microbe is a fungus or a fungal species. Examples of fungi that can be detected in accordance with the disclosed methods include without limitation any one or more of (or any combination of), *Aspergillus*, *Blastomyces*, *Candidiasis*, *Coccidiodomycosis*, *Cryptococcus neoformans*, *Cryptococcus gatti*, sp. *Histoplasma* sp. (such as *Histoplasma capsulatum*), *Pneumocystis* sp. (such as *Pneumocystis jirovecii*), *Stachybotrys* (such as *Stachybotrys chartarum*), *Mucroymcosis*, *Sporothrix*, fungal eye infections ringworm, *Exserohilum*, *Cladosporium*.

In certain example embodiments, the fungus is a yeast. Examples of yeast that can be detected in accordance with disclosed methods include without limitation one or more of (or any combination of), *Aspergillus* species (such as *Aspergillus fumigatus*, *Aspergillus flavus* and *Aspergillus clavatus*), *Cryptococcus* sp. (such as *Cryptococcus neoformans*, *Cryptococcus gattii*, *Cryptococcus laurentii* and *Cryptococcus albidus*), a *Geotrichum* species, a *Saccharomyces* species, a *Hansenula* species, a *Candida* species (such as *Candida albicans*), a *Kluyveromyces* species, a *Debaryomyces* species, a *Pichia* species, or combination thereof. In certain example embodiments, the fungus is a mold. Example molds include, but are not limited to, a *Penicillium* species, a *Cladosporium* species, a *Byssochlamys* species, or a combination thereof.

Protozoa

In certain example embodiments, the microbe is a protozoan. Examples of protozoa that can be detected in accordance with the disclosed methods and devices include without limitation any one or more of (or any combination of), *Euglenozoa*, *Heterolobosea*, *Diplomonadida*, *Amoebozoa*, *Blastocystic*, and *Apicomplexa*. Example Euglenoza include, but are not limited to, *Trypanosoma cruzi* (Chagas disease), *T. brucei gambiense*, *T. brucei rhodesiense*, *Leishmania braziliensis*, *L. infantum*, *L. mexicana*, *L. major*, *L. tropica*, and *L. donovani*. Example Heterolobosea include, but are not limited to, *Naegleria fowleri*. Example Diplomonadid include, but are not limited to, *Giardia intestinalis* (*G. lamblia*, *G. duodenalis*). Example Amoebozoa include, but are not limited to, *Acanthamoeba castellanii*, *Balamuthia madrillaris*, *Entamoeba histolytica*. Example Blastocystis include, but are not limited to, *Blastocystic hominis*. Example Apicomplexa include, but are not limited to, *Babesia microti*, *Cryptosporidium parvum*, *Cyclospora cayetanensis*, *Plasmodium falciparum*, *P. vivax*, *P. ovale*, *P. malariae*, and *Toxoplasma gondii*.

Parasites

In certain example embodiments, the microbe is a parasite. Examples of parasites that can be detected in accordance with the disclosed methods include without limitation one or more of (or any combination of), an *Onchocerca* species and a *Plasmodium* species.

Viruses

In certain example embodiments, the systems, devices, and methods, disclosed herein are directed to detecting viruses in a sample. The embodiments disclosed herein may be used to detect viral infection (e.g. of a subject or plant), or determination of a viral strain, including viral strains that differ by a single nucleotide polymorphism. The virus may be a DNA virus, an RNA virus, or a retrovirus. Non-limiting examples of viruses useful with the present invention include, but are not limited to Ebola, measles, SARS, Chikungunya, hepatitis, Marburg, yellow fever, MERS, Dengue, Lassa, influenza, rhabdovirus or HIV. A hepatitis virus may include hepatitis A, hepatitis B, or hepatitis C. An influenza virus may include, for example, influenza A or influenza B. An HIV may include HIV 1 or HIV 2. In certain example embodiments, the viral sequence may be a human respiratory syncytial virus, Sudan ebola virus, Bundibugyo virus, Tai Forest ebola virus, Reston ebola virus, Achimota, *Aedes* flavivirus, Aguacate virus, Akabane virus, Alethinophid reptarenavirus, Allpahuayo mammarenavirus, Amapari mmarenavirus, Andes virus, Apoi virus, Aravan virus, Aroa virus, Arumwot virus, Atlantic salmon paramyoxivirus, Australian bat lyssavirus, Avian bornavirus, Avian metapneumovirus, Avian paramyoxviruses, penguin or Falkland Islandsvirus, BK polyomavirus, Bagaza virus, Banna virus, Bat hepevirus, Bat sapovirus, Bear Canon mammarenavirus, Beilong virus, Betacoronoavirus, Betapapillomavirus 1-6, Bhanja virus, Bokeloh bat lyssavirus, Borna disease virus, Bourbon virus, Bovine hepacivirus, Bovine parainfluenza virus 3, Bovine respiratory syncytial virus, Brazoran virus, Bunyamwere virus, Caliciviridae virus. California encephalitis virus, Candiru virus, Canine distemper virus, Canaine pneumovirus, Cedar virus, Cell fusing agent virus, Cetacean morbillivirus, Chandipura virus, Chaoyang virus, Chapare mammarenavirus, Chikungunya virus, Colobus monkey papillomavirus, Colorado tick fever virus, Cowpox virus, Crimean-Congo hemorrhagic fever virus, *Culex* flavivirus, Cupixi mammarenavirus, Dengue virus, Dobrava-Belgrade virus, Donggang virus, Dugbe virus, Duvenhage virus, Eastern equine encephalitis virus, Entebbe bat virus, Enterovirus A-D, European bat lyssavirus 1-2, Eyach virus, Feline morbillivirus, Fer-de-Lance paramyxovirus, Fitzroy River virus, Flaviviridae virus, Flexal mammarenavirus, GB virus C, Gairo virus, Gemycircularvirus, Goose paramyoxiviurs SF02, Great Island virus, Guanarito mammarenavirus, Hantaan virus, Hantavirus Z10, Heartland virus, Hendra virus, Hepatitis A/B/C/E, Hepatitis delta virus, Human bocavirus, Human coronavirus, Human endogenous retrovirus K, Human enteric coronavirus, Human gential-associated circular DNA virus-1, Human herpesvirus 1-8, Human immunodeficiency virus 1/2, Huan mastadenovirus A-G, Human papillomavirus, Human parainfluenza virus 1-4, Human paraechovirus, Human picobirnavirus, Human smacovirus, Ikoma lyssavirus, Ilheus virus, Influenza A-C, Ippy mammarenavirus, Irkut virus, J-virus, JC polyomavirus, Japanses encephalitis virus, Junin mammarenavirus, KI polyomavirus, Kadipiro virus, Kamiti River virus, Kedougou virus, Khujand virus, Kokobera virus, Kyasanur forest disease virus, Lagos bat virus, Langat virus, Lassa mammarenavirus, Latino mammarenavirus, Leopards Hill virus, Liao ning virus, Ljungan virus, Lloviu virus, Louping ill virus, Lujo mammarenavirus, Luna mammarenavirus, Lunk virus, Lymphocytic choriomeningitis mammarenavirus, Lyssavirus Ozernoe, MSSI2\.225 virus, Machupo mammarenavirus, Mamastrovirus 1, Manzanilla virus, Mapuera virus, Marburg virus, Mayaro virus, Measles virus, Menangle virus, Mercadeo virus, Merkel cell polyomavirus, Middle East respiratory syndrome coronavirus, Mobala mammarenavirus, Modoc virus, Moijang virus, Mokolo virus, Monkeypox virus, Montana *myotis* leukoenchalitis virus, Mopeia lassa virus reassortant 29, Mopeia mammarenavirus, Morogoro virus, Mossman virus, Mumps virus, Murine pneumonia virus, Murray Valley encephalitis virus, Nariva virus, Newcastle disease virus, Nipah virus, Norwalk virus, Norway rat hepacivirus, Ntaya virus, O'nyong-nyong virus, Oliveros mammarenavirus, Omsk hemorrhagic fever virus, Oropouche virus, Parainfluenza virus 5, Parana mammarenavirus, Parramatta River virus, Peste-des-petits-ruminants virus, Pichande mammarenavirus, Picornaviridae virus, Pirital mammarenavirus, Piscihepevirus A, Porcine parainfluenza virus 1, porcine rubulavirus, Powassan virus, Primate T-lymphotropic virus 1-2, Primate erythroparvovirus 1, Punta Toro virus, Puumala virus, Quang Binh virus, Rabies virus, Razdan virus, Reptile bornavirus 1, Rhinovirus A-B, Rift Valley fever virus, Rinderpest virus, Rio Bravo virus, Rodent Torque Teno virus, Rodent hepacivirus, Ross River virus, Rotavirus A-I, Royal Farm virus, Rubella virus, Sabia mammarenavirus, Salem virus, Sandfly fever Naples virus, Sandfly fever Sicilian virus, Sapporo virus, Sathuperi virus, Seal anellovirus, Semliki Forest virus, Sendai virus, Seoul virus, Sepik virus, Severe acute respiratory syndrome-related coronavirus, Severe fever with thrombocytopenia syndrome virus, Shamonda virus, Shimoni bat virus, Shuni virus, Simbu virus, Simian torque teno virus, Simian virus 40-41, Sin Nombre virus, Sindbis virus, Small anellovirus, Sosuga virus, Spanish goat encephalitis virus, Spondweni virus, St. Louis encephalitis virus, Sunshine virus, TTV-like mini virus, Tacaribe mammarenavirus, Taila virus, Tamana bat virus, Tamiami mammarenavirus, Tembusu virus, Thogoto virus, Thottapalayam virus, Tick-borne encephalitis virus, Tioman virus, Togaviridae virus, Torque teno *canis* virus, Torque teno douroucouli virus, Torque teno *felis* virus, Torque teno midi virus, Torque teno sus virus, Torque teno tamarin virus, Torque teno virus, Torque teno *zalophus* virus, Tuhoko virus, Tula virus, Tupaia paramyxovirus, Usutu virus, Uukuniemi virus, Vaccinia virus, Variola virus, Venezuelan equine encephalitis virus, Vesicular stomatitis Indiana virus, WU Polyomavirus, Wesselsbron virus, West Caucasian bat virus, West Nile virus, Western equine encephalitis virus, Whitewater Arroyo mammarenavirus, Yellow fever virus, Yokose virus, Yug Bogdanovac virus, Zaire ebolavirus, Zika virus, or *Zygosaccharomyces bailii* virus Z viral sequence. Examples of RNA viruses that may be detected include one or more of (or any combination of) Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus. In certain example embodiments, the virus is Coronavirus, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus.

In certain example embodiments, the virus may be a plant virus selected from the group comprising Tobacco mosaic virus (TMV), Tomato spotted wilt virus (TSWV), Cucumber mosaic virus (CMV), Potato virus Y (PVY), the RT virus Cauliflower mosaic virus (CaMV), Plum pox virus (PPV), Brome mosaic virus (BMV), Potato virus X (PVX), Citrus tristeza virus (CTV), Barley yellow dwarf virus (BYDV), Potato leafroll virus (PLRV), Tomato bushy stunt virus (TBSV), rice tungro spherical virus (RTSV), rice yellow mottle virus (RYMV), rice hoja blanca virus (RHBV), maize rayado fino virus (MRFV), maize dwarf mosaic virus (MDMV), sugarcane mosaic virus (SCMV), Sweet potato feathery mottle virus (SPFMV), sweet potato sunken vein closterovirus (SPSVV), Grapevine fanleaf virus (GFLV), Grapevine virus A (GVA), Grapevine virus B (GVB), Grapevine fleck virus (GFkV), Grapevine leafroll-associated virus-1, -2, and -3, (GLRaV-1, -2, and -3), *Arabis* mosaic virus (ArMV), or *Rupestris* stem pitting-associated virus (RSPaV). In a preferred embodiment, the target RNA molecule is part of said pathogen or transcribed from a DNA molecule of said pathogen. For example, the target sequence may be comprised in the genome of an RNA virus. It is further preferred that CRISPR effector protein hydrolyzes said target RNA molecule of said pathogen in said plant if said pathogen infects or has infected said plant. It is thus preferred that the CRISPR system is capable of cleaving the target RNA molecule from the plant pathogen both when the CRISPR system (or parts needed for its completion) is applied therapeutically, i.e. after infection has occurred or prophylactically, i.e. before infection has occurred.

In certain example embodiments, the virus may be a retrovirus. Example retroviruses that may be detected using the embodiments disclosed herein include one or more of or any combination of viruses of the Genus Alpharetrovirus, Betaretrovirus, Gammaretrovirus, Deltaretrovirus, Epsilonretrovirus, Lentivirus, Spumavirus, or the Family Metaviridae, Pseudoviridae, and Retroviridae (including HIV), Hepadnaviridae (including Hepatitis B virus), and Caulimoviridae (including Cauliflower mosaic virus).

In certain example embodiments, the virus is a DNA virus. Example DNA viruses that may be detected using the embodiments disclosed herein include one or more of (or any combination of) viruses from the Family Myoviridae, Podoviridae, Siphoviridae, Alloherpesviridae, Herpesviridae (including human herpes virus, and Varicella Zoster virus), Malocoherpesviridae, Lipothrixviridae, Rudiviridae, Adenoviridae, Ampullaviridae, Ascoviridae, Asfarviridae (including African swine fever virus), Baculoviridae, Cicaudaviridae, Clavaviridae, Corticoviridae, Fuselloviridae, Globuloviridae, Guttaviridae, Hytrosaviridae, Iridoviridae, Maseilleviridae, Mimiviridae, Nudiviridae, Nimaviridae, Pandoraviridae, Papillomaviridae, Phycodnaviridae, Plasmaviridae, Polydnaviruses, Polyomaviridae (including Simian virus 40, JC virus, BK virus), Poxviridae (including Cowpox and smallpox), Sphaerolipoviridae, Tectiviridae, Turriviridae, Dinodnavirus, Salterprovirus, Rhizidovirus, among others. In some embodiments, a method of diagnosing a species-specific bacterial infection in a subject suspected of having a bacterial infection is described as obtaining a sample comprising bacterial ribosomal ribonucleic acid from the subject; contacting the sample with one or more of the probes described, and detecting hybridization between the bacterial ribosomal ribonucleic acid sequence present in the sample and the probe, wherein the detection of hybridization indicates that the subject is infected with *Escherichia coli, Klebsiella pneumoniae, Pseudomonas aeruginosa, Staphylococcus aureus, Acinetobacter baumannii, Candida albicans, Enterobacter cloacae, Enterococcus faecalis, Enterococcus faecium, Proteus mirabilis, Staphylococcus agalactiae,* or *Staphylococcus maltophilia* or a combination thereof.

Malaria Detection and Monitoring

Malaria is a mosquito-borne pathology caused by *Plasmodium* parasites. The parasites are spread to people through the bites of infected female *Anopheles* mosquitoes. Five *Plasmodium* species cause malaria in humans: *Plasmodium falciparum, Plasmodium vivax, Plasmodium ovale, Plasmodium malariae,* and *Plasmodium knowlesi*. Among them, according to the World Health Organization (WHO), *Plasmodium falciparum*: and *Plasmodium vivax* are responsible for the greatest threat. *P. falciparum* is the most prevalent malaria parasite on the African continent and is responsible for most malaria-related deaths globally. *P. vivax* is the dominant malaria parasite in most countries outside of sub-Saharan Africa.

In 2015, 91 countries and areas had ongoing malaria transmission. According to the latest WHO estimates, there were 212 million cases of malaria in 2015 and 429 000 deaths. In areas with high transmission of malaria, children under 5 are particularly susceptible to infection, illness and death; more than two thirds (70%) of all malaria deaths occur in this age group. Between 2010 and 2015, the under-5 malaria death rate fell by 29% globally. However, malaria remains a maj or killer of children under five years old, taking the life of a child every two minutes.

As described by the WHO, malaria is an acute febrile illness. In a non-immune individual, symptoms appear 7 days or more after the infective mosquito bite. The first symptoms—fever, headache, chills and vomiting—may be mild and difficult to recognize as malaria, however, if not treated within 24 hours, *P. falciparum* malaria can progress to severe illness, often leading to death.

Children with severe malaria frequently develop one or more of the following symptoms: severe anaemia, respiratory distress in relation to metabolic acidosis, or cerebral malaria. In adults, multi-organ involvement is also frequent. In malaria endemic areas, people may develop partial immunity, allowing asymptomatic infections to occur.

The development of rapid and efficient diagnostic tests is of high relevance for public health. Indeed, early diagnosis and treatment of malaria not only reduces disease and prevents deaths but also contributes to reducing malaria transmission. According to the WHO recommendations, all cases of suspected malaria should be confirmed using parasite-based diagnostic testing (notably using a rapid diagnostic test) before administering treatment (see "WHO Guidelines for the treatment of malaria", third edition, published in April 2015).

Resistance to antimalarial therapies represents a critical health problem which drastically reduces therapeutic strategies. Indeed, as reported on the WHO website, resistance of *P. falciparum* to previous generations of medicines, such as chloroquine and sulfadoxine/pyrimethamine (SP), became widespread in the 1950s and 1960s, undermining malaria control efforts and reversing gains in child survival. Thus, the WHO recommends the routine monitoring of antimalarial drug resistance. Indeed, accurate diagnosis may avoid non-appropriate treatments and limit extension of resistance to antimalarial medicines.

In this context, the WHO Global Technical Strategy for Malaria 2016-2030—adopted by the World Health Assembly in May 2015—provides a technical framework for all malaria-endemic countries. It is intended to guide and support regional and country programs as they work towards malaria control and elimination. The Strategy sets ambitious but achievable global targets, including:

Reducing malaria case incidence by at least 90% by 2030.
Reducing malaria mortality rates by at least 90% by 2030.
Eliminating malaria in at least 35 countries by 2030.
Preventing a resurgence of malaria in all countries that are malaria-free.

This Strategy was the result of an extensive consultative process that spanned 2 years and involved the participation of more than 400 technical experts from 70 Member States. It is based on 3 key axes:

ensuring universal access to malaria prevention, diagnosis and treatment;
accelerating efforts towards elimination and attainment of malaria-free status; and
transforming malaria surveillance into a core intervention.

Treatments against *Plasmodium* include aryl-amino alcohols such as quinine or quinine derivatives such as chloroquine, amodiaquine, mefloquine, piperaquine, lumefantrine, primaquine; lipophilic hydroxynaphthoquinone analog, such as atovaquone; antifolate drugs, such as the sulfa drugs sulfadoxine, dapsone and pyrimethamine; proguanil; the combination of atovaquone/proguanil; atemisins drugs; and combinations thereof.

Target sequences that are diagnostic for the presence of a mosquito-borne pathogen include sequences that are diagnostic for the presence of *Plasmodium*, notably Plasmodia species affecting humans such as *Plasmodium falciparum, Plasmodium vivax, Plasmodium ovale, Plasmodium malariae,* and *Plasmodium knowlesi*, including sequences from the genomes thereof.

Target sequences that are diagnostic for monitoring drug resistance to treatment against *Plasmodium*, notably Plasmodia species affecting humans such as *Plasmodium falciparum, Plasmodium vivax, Plasmodium ovale, Plasmodium malariae,* and *Plasmodium knowlesi*.

Further target sequences include target molecules/nucleic acid molecules coding for proteins involved in essential biological processes for the *Plasmodium* parasite and notably transporter proteins, such as proteins from the drug/metabolite transporter family, the ATP-binding cassette (ABC) protein involved in substrate translocation, such as the ABC transporter C subfamily or the Na+/H$^+$ exchanger, membrane glutathione S-transferase; proteins involved in the folate pathway, such as the dihydropteroate synthase, the dihydrofolate reductase activity or the dihydrofolate reductase-thymidylate synthase; and proteins involved in the translocation of protons across the inner mitochondrial membrane and notably the cytochrome b complex. Additional targets may also include the gene(s) coding for the heme polymerase.

Further target sequences include target molecules/nucleic acid molecules coding for proteins involved in essential biological processes that may be selected from the *P. falciparum* chloroquine resistance transporter gene (pfcrt), the *P. falciparum* multidrug resistance transporter 1 (pfmdr1), the *P. falciparum* multidrug resistance-associated protein gene (Pfinrp), the *P. falciparum* Na+/H+ exchanger gene (pfnhe), the gene coding for the *P. falciparum* exported protein 1, the *P. falciparum* Ca2+ transporting ATPase 6 (pfatp6); the *P. falciparum* dihydropteroate synthase (pfdhps), dihydrofolate reductase activity (pfdhpr) and dihydrofolate reductase-thymidylate synthase (pfdhfr) genes, the cytochrome b gene, GTP cyclohydrolase and the Kelch13 (K13) gene as well as their functional heterologous genes in other *Plasmodium* species.

A number of mutations, notably single point mutations, have been identified in the proteins which are the targets of the current treatments and associated with specific resistance phenotypes. Accordingly, the invention allows for the detection of various resistance phenotypes of mosquito-borne parasites, such as *plasmodium*.

The invention allows to detect one or more mutation(s) and notably one or more single nucleotide polymorphisms in target nucleic acids/molecules. Accordingly, any one of the mutations below, or combination thereof, can be used as a drug resistance marker and can be detected according to the invention.

Single point mutations in *P. falciparum* K13 include the following single point mutations in positions 252, 441, 446, 449, 458, 493, 539, 543, 553, 561, 568, 574, 578, 580, 675, 476, 469, 481, 522, 537, 538, 579, 584 and 719 and notably mutations E252Q, P441L, F446I, G449A, N458Y, Y493H, R539T, I543T, P553L, R561H, V568G, P574L, A578S, C580Y, A675V, M476I; C469Y; A481V; S522C; N537I; N537D; G538V; M579I; D584V; and H719N. These mutations are generally associated with artemisinin drugs resistance phenotypes (Artemisinin and artemisinin-based combination therapy resistance, April 2016 WHO/HTMGMP/2016.5).

In the *P. falciparum* dihydrofolate reductase (DHFR) (PJDHFR-TS, PFD0830w), important polymorphisms include mutations in positions 108, 51, 59 and 164, notably 108 D, 164L, 511 and 59R, which modulate resistance to pyrimethamine. Other polymorphisms also include 437G, 581G, 540E, 436A and 613S which are associated with resistance to sulfadoxine. Additional observed mutations include Ser108Asn, Asn51Ile, Cys59Arg, Ile164Leu, Cys50Arg, Ile164Leu, Asn188Lys, Ser189Arg and Val213Ala, Ser108Thr and Ala16Val. Mutations Ser108Asn, Asn51Ile, Cys59Arg, Ile164Leu, Cys50Arg, Ile164Leu are notably associated with pyrimethamine based therapy and/or chloroguanine-dapsone combination therapy resistances. Cycloguanil resistance appears to be associated with the double mutations Ser108Thr and Ala16Val. Amplification of dhfr may also be of high relevance for therapy resistance, notably pyrimethamine resistance.

In the *P. falciparum* dihydropteroate synthase (DHPS) (PfDHPS, PF08_0095), important polymorphisms include mutations in positions 436, 437, 581 and 613 Ser436Ala/Phe, Ala437Gly, Lys540Glu, Ala581Gly and Ala613Thr/Ser. Polymorphism in position 581 and/or 613 have also been associated with resistance to sulfadoxine-pyrimethamine base therapies.

In the *P. falciparum* chloroquine-resistance transporter (PJCRT), polymorphism in position 76, notably the mutation Lys76Thr, is associated with resistance to chloroquine. Further polymorphisms include Cys72Ser, Met74Ile, Asn75Glu, Ala220Ser, Gln271Glu, Asn326Ser, Ile356Thr and Arg371Ile which may be associated with chloroquine resistance. PfCRT is also phosphorylated at residues S33, S411 and T416, which may regulate the transport activity or specificity of the protein.

In the *P. falciparum* multidrug-resistance transporter 1 (PfMDR1) (PFE1150w), polymorphisms in positions 86, 184, 1034, 1042, notably Asn86Tyr, Tyr184-Phe, Ser1034Cys, Asn1042Asp and Asp1246Tyr have been identified and reported to influence susceptibilities to lumefantrine, artemisinin, quinine, mefloquine, halofantrine and chloroquine. Additionally, amplification of PfMDR1 is associated with reduced susceptibility to lumefantrine, artemisinin, quinine, mefloquine, and halofantrine and deamplification of PfMDR1 leads to an increase in chloroquine resistance. Amplification of pfmdr1 may also be detected. The phosphorylation status of PfMDR1 is also of high relevance.

In the *P. falciparum* multidrug-resistance associated protein (PfMRP) (gene reference PFA0590w), polymorphisms in positions 191 and/or 437, such as Y191H and A437S have been identified and associated with chloroquine resistance phenotypes.

In the *P. falciparum* NA+/H+ exchanger (PfNHE) (ref PF13_0019), increased repetition of the DNNND in microsatellite ms4670 may be a marker for quinine resistance.

Mutations altering the ubiquinol binding site of the cytochrome b protein encoded by the cytochrome bc gene (cytb, mal_mito_3) are associated with atovaquone resistance. Mutations in positions 26, 268, 276, 133 and 280 and notably Tyr26Asn, Tyr268Ser, M133I and G280D may be associated with atovaquone resistance.

For example in *P. Vivax*, mutations in PvMDR1, the homolog of Pf MDR1 have been associated with chloroquine resistance, notably a polymorphism in position 976 such as the mutation Y976F.

The above mutations are defined in terms of protein sequences. However, the skilled person is able to determine the corresponding mutations, including SNPS, to be identified as a nucleic acid target sequence.

Other identified drug-resistance markers are known in the art, for example as described in "*Susceptibility of Plasmodium falciparum to antimalarial drugs (1996-2004)*"; WHO; Artemisinin and artemisinin-based combination therapy resistance (April 2016 WHO/HTM/GMP/2016.5); "*Drug-resistant malaria: molecular mechanisms and implications for public health*" FEBS Lett. 2011 Jun. 6; 585(11): 1551-62. doi:10.1016/j.febslet.2011.04.042. Epub 2011 Apr. 23. Review. PubMed PMID: 21530510; the contents of which are herewith incorporated by reference.

As to polypeptides that may be detected in accordance with the present invention, gene products of all genes mentioned herein may be used as targets. Correspondingly, it is contemplated that such polypeptides could be used for species identification, typing and/or detection of drug resistance.

In certain example embodiments, the systems, devices, and methods, disclosed herein are directed to detecting the presence of one or more mosquito-borne parasites in a sample, such as a biological sample obtained from a subject. In certain example embodiments, the parasite may be selected from the species *Plasmodium falciparum, Plasmodium vivax, Plasmodium ovale, Plasmodium malariae* or *Plasmodium knowlesi*. Accordingly, the methods disclosed herein can be adapted for use in other methods (or in combination) with other methods that require quick identification of parasite species, monitoring the presence of parasites and parasite forms (for example corresponding to various stages of infection and parasite life-cycle, such as exo-erythrocytic cycle, erythrocytic cycle, sporpogonic cycle; parasite forms including merozoites, sporozoites, schizonts, gametocytes); detection of certain phenotypes (e.g. pathogen drug resistance), monitoring of disease progression and/or outbreak, and treatment (drug) screening. Further, in the case of malaria, a long time may elapse following the infective bite, namely a long incubation period, during which the patient does not show symptoms. Similarly, prophylactic treatments can delay the appearance of symptoms, and long asymptomatic periods can also be observed before a relapse. Such delays can easily cause misdiagnosis or delayed diagnosis, and thus impair the effectiveness of treatment.

Because of the rapid and sensitive diagnostic capabilities of the embodiments disclosed here, detection of parasite type, down to a single nucleotide difference, and the ability to be deployed as a POC device, the embodiments disclosed herein may be used to guide therapeutic regimens, such as selection of the appropriate course of treatment. The embodiments disclosed herein may also be used to screen environmental samples (mosquito population, etc.) for the presence and the typing of the parasite. The embodiments may also be modified to detect mosquito-borne parasites and other mosquito-borne pathogens simultaneously. In some instances, malaria and other mosquito-borne pathogens may present initially with similar symptoms. Thus, the ability to quickly distinguish the type of infection can guide important treatment decisions. Other mosquito-borne pathogens that may be detected in conjunction with malaria include dengue, West Nile virus, chikungunya, yellow fever, filariasis, Japanese encephalitis, Saint Louis encephalitis, western equine encephalitis, eastern equine encephalitis, Venezuelan equine encephalitis, La Crosse encephalitis, and Zika.

In certain example embodiments, the devices, systems, and methods disclosed herein may be used to distinguish multiple mosquito-borne parasite species in a sample. In certain example embodiments, identification may be based on ribosomal RNA sequences, including the 18S, 16S, 23S, and 5S subunits. In certain example embodiments, identification may be based on sequences of genes that are present in multiple copies in the genome, such as mitochondrial genes like CYTB. In certain example embodiments, identification may be based on sequences of genes that are highly expressed and/or highly conserved such as GAPDH, Histone H2B, enolase, or LDH. Methods for identifying relevant rRNA sequences are disclosed in U.S. Patent Application Publication No. 2017/0029872. In certain example embodiments, a set of guide RNAs may be designed to distinguish each species by a variable region that is unique to each species or strain. Guide RNAs may also be designed to target RNA genes that distinguish microbes at the genus, family, order, class, phylum, kingdom levels, or a combination thereof. In certain example embodiments where amplification is used, a set of amplification primers may be designed to flanking constant regions of the ribosomal RNA sequence and a guide RNA designed to distinguish each species by a variable internal region. In certain example embodiments, the primers and guide RNAs may be designed to conserved and variable regions in the 16S subunit respectfully. Other genes or genomic regions that are uniquely variable across species or a subset of species such as the RecA gene family, RNA polymerase 3 subunit, may be used as well. Other suitable phylogenetic markers, and methods for identifying the same, are discussed for example in Wu et al. arXiv: 1307.8690 [q-bio.GN].

In certain example embodiments, species identification can be performed based on genes that are present in multiple copies in the genome, such as mitochondrial genes like CYTB. In certain example embodiments, species identification can be performed based on highly expressed and/or highly conserved genes such as GAPDH, Histone H2B, enolase, or LDH.

In certain example embodiments, a method or diagnostic is designed to screen mosquito-borne parasites across multiple phylogenetic and/or phenotypic levels at the same time. For example, the method or diagnostic may comprise the use of multiple CRISPR systems with different guide RNAs. A first set of guide RNAs may distinguish, for example, between *Plasmodium falciparum* or *Plasmodium vivax*. These general classes can be even further subdivided. For example, guide RNAs could be designed and used in the method or diagnostic that distinguish drug-resistant strains, in general or with respect to a specific drug or combination of drugs. A second set of guide RNAs can be designed to distinguish microbes at the species level. Thus, a matrix may be produced identifying all mosquito-borne parasites species or subspecies, further divided according to drug resistance. The foregoing is for example purposes only. Other means for classifying other types of mosquito-borne parasites are also contemplated and would follow the general structure described above.

In certain example embodiments, the devices, systems and methods disclosed herein may be used to screen for mosquito-borne parasite genes of interest, for example drug resistance genes. Guide RNAs may be designed to distinguish between known genes of interest. Samples, including clinical samples, may then be screened using the embodiments disclosed herein for detection of one or more such genes. The ability to screen for drug resistance at POC would have tremendous benefit in selecting an appropriate treatment regimen. In certain example embodiments, the drug resistance genes are genes encoding proteins such as transporter proteins, such as protein from drug/metabolite transporter family, the ATP-binding cassette (ABC) protein involved in substrate translocation, such as the ABC transporter C subfamily or the $Na^+/H^+$ exchanger; proteins involved in the folate pathway, such as the dihydropteroate synthase, the dihydrofolate reductase activity or the dihydrofolate reductase-thymidylate synthase; and proteins involved in the translocation of protons across the inner mitochondrial membrane and notably the cytochrome b complex. Additional targets may also include the gene(s) coding for the heme polymerase. In certain example embodiments, the drug resistance genes are selected from the *P. falciparum* chloroquine resistance transporter gene (pfcrt), the *P. falciparum* multidrug resistance transporter 1 (pfmdr1), the *P. falciparum* multidrug resistance-associated protein gene (Pfmrp), the *P. falciparum* Na+/H+ exchanger gene (pfnhe), the *P. falciparum* Ca2+ transporting ATPase 6 (pfatp6), the *P. falciparum* dihydropteroate synthase (pfdhps), dihydrofolate reductase activity (pfdhpr) and dihydrofolate reductase-thymidylate synthase (pfdhfr) genes, the cytochrome b gene, GTP cyclohydrolase and the Kelch13 (K13) gene as well as their functional heterologous genes in other *Plasmodium* species. Other identified drug-resistance markers are known in the art, for example as described in "Susceptibility of *Plasmodium falciparum* to antimalarial drugs (1996-2004)"; WHO; Artemisinin and artemisinin-based combination therapy resistance (April 2016 WHO/HTM/GMP/2016.5); "*Drug-resistant malaria: molecular mechanisms and implications for public health*" FEBS Lett. 2011 Jun. 6; 585(11):1551-62. doi: 10.1016/j.febslet.2011.04.042. Epub 2011 Apr. 23. Review. PubMed PMID: 21530510; the contents of which are herewith incorporated by reference.

In some embodiments, a CRISPR system, detection system or methods of use thereof as described herein may be used to determine the evolution of a mosquito-borne parasite outbreak. The method may comprise detecting one or more target sequences from a plurality of samples from one or more subjects, wherein the target sequence is a sequence from a mosquito-borne parasite spreading or causing the outbreaks. Such a method may further comprise determining a pattern of mosquito-borne parasite transmission, or a mechanism involved in a disease outbreak caused by a mosquito-borne parasite. The samples may be derived from one or more humans, and/or be derived from one or more mosquitoes.

The pattern of pathogen transmission may comprise continued new transmissions from the natural reservoir of the mosquito-borne parasite or other transmissions (e.g. across mosquitoes) following a single transmission from the natural reservoir or a mixture of both. In one embodiment, the target sequence is preferably a sequence within the mosquito-borne parasite genome or fragments thereof. In one embodiment, the pattern of the mosquito-borne parasite transmission is the early pattern of the mosquito-borne parasite transmission, i.e. at the beginning of the mosquito-borne parasite outbreak. Determining the pattern of the mosquito-borne parasite transmission at the beginning of the outbreak increases likelihood of stopping the outbreak at the earliest possible time thereby reducing the possibility of local and international dissemination.

Determining the pattern of the mosquito-borne parasite transmission may comprise detecting a mosquito-borne parasite sequence according to the methods described herein. Determining the pattern of the pathogen transmission may further comprise detecting shared intra-host variations of the mosquito-borne parasite sequence between the subjects and determining whether the shared intra-host variations show temporal patterns. Patterns in observed intrahost and interhost variation provide important insight about transmission and epidemiology (Gire, et al., 2014).

In addition to other sample types disclosed herein, the sample may be derived from one or more mosquitoes, for example the sample may comprise mosquito saliva.

Biomarker Detection

In certain example embodiments, the systems, devices, and methods disclosed herein may be used for biomarker detection. For example, the systems, devices and method disclosed herein may be used for SNP detection and/or genotyping. The systems, devices and methods disclosed herein may be also used for the detection of any disease state or disorder characterized by aberrant gene expression. Aberrant gene expression includes aberration in the gene expressed, location of expression and level of expression. Multiple transcripts or protein markers related to cardiovascular, immune disorders, and cancer among other diseases may be detected. In certain example embodiments, the embodiments disclosed herein may be used for cell free DNA detection of diseases that involve lysis, such as liver fibrosis and restrictive/obstructive lung disease. In certain example embodiments, the embodiments could be utilized for faster and more portable detection for pre-natal testing of cell-free DNA. The embodiments disclosed herein may be used for screening panels of different SNPs associated with, among others, cardiovascular health, lipid/metabolic signatures, ethnicity identification, paternity matching, human ID (e.g. matching suspect to a criminal database of SNP signatures). The embodiments disclosed herein may also be used for cell free DNA detection of mutations related to and released from cancer tumors. The embodiments disclosed herein may also be used for detection of meat quality, for example, by providing rapid detection of different animal sources in a given meat product. Embodiments disclosed herein may also be used for the detection of GMOs or gene editing related to DNA. As described herein elsewhere, closely related genotypes/alleles or biomarkers (e.g. having only a single nucleotide difference in a given target sequence) may be distinguished by introduction of a synthetic mismatch in the gRNA.

In an aspect, the invention relates to a method for detecting target nucleic acids in samples, comprising:
distributing a sample or set of samples into one or more individual discrete volumes, the individual discrete volumes comprising a CRISPR system according to the invention as described herein;
incubating the sample or set of samples under conditions sufficient to allow binding of the one or more guide RNAs to one or more target molecules;
activating the CRISPR effector protein via binding of the one or more guide RNAs to the one or more target molecules, wherein activating the CRISPR effector protein results in modification of the RNA-based masking construct such that a detectable positive signal is generated; and
detecting the detectable positive signal, wherein detection of the detectable positive signal indicates a presence of one or more target molecules in the sample.

Biomarker Sample Types

The sensitivity of the assays described herein is well suited for detection of target nucleic acids in a wide variety of biological sample types, including sample types in which the target nucleic acid is dilute or for which sample material is limited. Biomarker screening may be carried out on a number of sample types including, but not limited to, saliva, urine, blood, feces, sputum, and cerebrospinal fluid. The embodiments disclosed herein may also be used to detect up- and/or down-regulation of genes. For example, a sample may be serially diluted such that only over-expressed genes remain above the detection limit threshold of the assay.

In certain embodiments, the present invention provides steps of obtaining a sample of biological fluid (e.g., urine, blood plasma or serum, sputum, cerebral spinal fluid), and extracting the DNA. The mutant nucleotide sequence to be detected, may be a fraction of a larger molecule or can be present initially as a discrete molecule.

In certain embodiments, DNA is isolated from plasma/serum of a cancer patient. For comparison, DNA samples isolated from neoplastic tissue and a second sample may be isolated from non-neoplastic tissue from the same patient (control), for example, lymphocytes. The non-neoplastic tissue can be of the same type as the neoplastic tissue or from a different organ source. In certain embodiments, blood samples are collected and plasma immediately separated from the blood cells by centrifugation. Serum may be filtered and stored frozen until DNA extraction.

In certain example embodiments, target nucleic acids are detected directly from a crude or unprocessed sample, such as blood, serum, saliva, cerebrospinal fluid, sputum, or urine. In certain example embodiments, the target nucleic acid is cell free DNA.

Circulating Tumor Cells

In one embodiment, circulating cells (e.g., circulating tumor cells (CTC)) can be assayed with the present invention. Isolation of circulating tumor cells (CTC) for use in any of the methods described herein may be performed. Exemplary technologies that achieve specific and sensitive detection and capture of circulating cells that may be used in the present invention have been described (Mostert B, et al., Circulating tumor cells (CTCs): detection methods and their clinical relevance in breast cancer. Cancer Treat Rev. 2009; 35:463-474; and Talasaz A H, et al., Isolating highly enriched populations of circulating epithelial cells and other rare cells from blood using a magnetic sweeper device. Proc Natl Acad Sci USA. 2009; 106:3970-3975). As few as one CTC may be found in the background of 105-106 peripheral blood mononuclear cells (Ross A A, et al., Detection and viability of tumor cells in peripheral blood stem cell collections from breast cancer patients using immunocytochemical and clonogenic assay techniques. Blood. 1993,82:2605-2610). The CellSearch® platform uses immunomagnetic beads coated with antibodies to Epithelial Cell Adhesion Molecule (EpCAM) to enrich for EPCAM-expressing epithelial cells, followed by immunostaining to confirm the presence of cytokeratin staining and absence of the leukocyte marker CD45 to confirm that captured cells are epithelial tumor cells (Momburg F, et al., Immunohistochemical study of the expression of a Mr 34,000 human epithelium-specific surface glycoprotein in normal and malignant tissues. Cancer Res. 1987; 47:2883-2891; and Allard W J, et al., Tumor cells circulate in the peripheral blood of all major carcinomas but not in healthy subjects or patients with nonmalignant diseases. Clin Cancer Res. 2004; 10:6897-6904). The number of cells captured have been prospectively demonstrated to have prognostic significance for breast, colorectal and prostate cancer patients with advanced disease (Cohen S J, et al., J Clin Oncol. 2008; 26:3213-3221; Cristofanilli M, et al. N Engl J Med. 2004; 351:781-791; Cristofanilli M, et al., J Clin Oncol. 2005; 23: 1420-1430; and de Bono J S, et al. Clin Cancer Res. 2008; 14:6302-6309).

The present invention also provides for isolating CTCs with CTC-Chip Technology. CTC-Chip is a microfluidic based CTC capture device where blood flows through a chamber containing thousands of microposts coated with anti-EpCAM antibodies to which the CTCs bind (Nagrath S, et al. Isolation of rare circulating tumour cells in cancer patients by microchip technology. Nature. 2007; 450: 1235-1239). CTC-Chip provides a significant increase in CTC counts and purity in comparison to the CellSearch® system (Maheswaran S, et al. Detection of mutations in EGFR in circulating lung-cancer cells, N Engl J Med. 2008; 359:366-377), both platforms may be used for downstream molecular analysis.

Cell-Free Chromatin

In certain embodiments, cell free chromatin fragments are isolated and analyzed according to the present invention. Nucleosomes can be detected in the serum of healthy individuals (Stroun et al., Annals of the New York Academy of Sciences 906: 161-168 (2000)) as well as individuals afflicted with a disease state. Moreover, the serum concentration of nucleosomes is considerably higher in patients suffering from benign and malignant diseases, such as cancer and autoimmune disease (Holdenrieder et al (2001) Int J Cancer 95, 1 14-120, Trejo-Becerril et al (2003) Int J Cancer 104, 663-668; Kuroi et al 1999 Breast Cancer 6, 361-364; Kuroi et al (2001) Intj Oncology 19, 143-148; Amoura et al (1997) Arth Rheum 40, 2217-2225; Williams et al (2001) J Rheumatol 28, 81-94). Not being bound by a theory, the high concentration of nucleosomes in tumor bearing patients derives from apoptosis, which occurs spontaneously in proliferating tumors. Nucleosomes circulating in the blood contain uniquely modified histones. For example, U.S. Patent Publication No. 2005/0069931 (Mar. 31, 2005) relates to the use of antibodies directed against specific histone N-terminus modifications as diagnostic indicators of disease, employing such histone-specific antibodies to isolate nucleosomes from a blood or serum sample of a patient to facilitate purification and analysis of the accompanying DNA for diagnostic/screening purposes. Accordingly, the present invention may use chromatin bound DNA to detect and monitor, for example, tumor mutations. The identification of the DNA associated with modified histones can serve as a diagnostic marker of disease and congenital defects.

Thus, in another embodiment, isolated chromatin fragments are derived from circulating chromatin, preferably circulating mono and oligonucleosomes. Isolated chromatin fragments may be derived from a biological sample. The biological sample may be from a subject or a patient in need thereof. The biological sample may be sera, plasma, lymph, blood, blood fractions, urine, synovial fluid, spinal fluid, saliva, circulating tumor cells or mucous.

Cell-Free DNA (cfDNA)

In certain embodiments, the present invention may be used to detect cell free DNA (cfDNA). Cell free DNA in plasma or serum may be used as a non-invasive diagnostic tool. For example, cell free fetal DNA has been studied and optimized for testing non-compatible RhD factors, sex determination for X-linked genetic disorders, testing for single gene disorders, identification of preeclampsia. For example, sequencing the fetal cell fraction of cfDNA in maternal plasma is a reliable approach for detecting copy number changes associated with fetal chromosome aneuploidy. For another example, cfDNA isolated from cancer patients has been used to detect mutations in key genes relevant for treatment decisions.

In certain example embodiments, the present disclosure provides detecting cfDNA directly from a patient sample. In certain other example embodiment, the present disclosure provides enriching cfDNA using the enrichment embodiments disclosed above and prior to detecting the target cfDNA.

Exosomes

In one embodiment, exosomes can be assayed with the present invention. Exosomes are small extracellular vesicles that have been shown to contain RNA. Isolation of exosomes by ultracentrifugation, filtration, chemical precipitation, size exclusion chromatography, and microfluidics are known in the art. In one embodiment exosomes are purified using an exosome biomarker. Isolation and purification of exosomes from biological samples may be performed by any known methods (see e.g., WO2016172598A1).

SNP Detection and Genotyping

In certain embodiments, the present invention may be used to detect the presence of single nucleotide polymorphisms (SNP) in a biological sample. The SNPs may be related to maternity testing (e.g., sex determination, fetal defects). They may be related to a criminal investigation. In one embodiment, a suspect in a criminal investigation may be identified by the present invention. Not being bound by a theory nucleic acid based forensic evidence may require the most sensitive assay available to detect a suspect or victim's genetic material because the samples tested may be limiting.

In other embodiments, SNPs associated with a disease are encompassed by the present invention. SNPs associated with diseases are well known in the art and one skilled in the art can apply the methods of the present invention to design suitable guide RNAs (see e.g., www.ncbi.nlm.nih.gov/clinvar?term=human%5Borgn%5D).

In an aspect, the invention relates to a method for genotyping, such as SNP genotyping, comprising:
    distributing a sample or set of samples into one or more individual discrete volumes, the individual discrete volumes comprising a CRISPR system according to the invention as described herein;

incubating the sample or set of samples under conditions sufficient to allow binding of the one or more guide RNAs to one or more target molecules;

activating the CRISPR effector protein via binding of the one or more guide RNAs to the one or more target molecules, wherein activating the CRISPR effector protein results in modification of the RNA-based masking construct such that a detectable positive signal is generated; and detecting the detectable positive signal, wherein detection of the detectable positive signal indicates a presence of one or more target molecules characteristic for a particular genotype in the sample.

In certain embodiments, the detectable signal is compared to (e.g. by comparison of signal intensity) one or more standard signal, preferably a synthetic standard signal. In certain embodiments, the standard is or corresponds to a particular genotype. In certain embodiments, the standard comprises a particular SNP or other (single) nucleotide variation. In certain embodiments, the standard is a (PCR-amplified) genotype standard. In certain embodiments, the standard is or comprises DNA. In certain embodiments, the standard is or comprises RNA. In certain embodiments, the standard is or comprised RNA which is transcribed from DNA. In certain embodiments, the standard is or comprises DNA which is reverse transcribed from RNA. In certain embodiments, the detectable signal is compared to one or more standards, each of which corresponds to a known genotype, such as a SNP or other (single) nucleotide variation. In certain embodiments, the detectable signal is compared to one or more standard signals and the comparison comprises statistical analysis, such as by parametric or non-parametric statistical analysis, such as by one- or two-way ANOVA, etc. In certain embodiments, the detectable signal is compared to one or more standard signals and when the detectable signal does not (statistically) significantly deviate from the standard, the genotype is determined as the genotype corresponding to said standard.

In other embodiments, the present invention allows rapid genotyping for emergency pharmacogenomics. In one embodiment, a single point of care assay may be used to genotype a patient brought in to the emergency room. The patient may be suspected of having a blood clot and an emergency physician needs to decide a dosage of blood thinner to administer. In exemplary embodiments, the present invention may provide guidance for administration of blood thinners during myocardial infarction or stroke treatment based on genotyping of markers such as VKORC1, CYP2C9, and CYP2C19. In one embodiment, the blood thinner is the anticoagulant warfarin (Holford, NH (December 1986). "Clinical Pharmacokinetics and Pharmacodynamics of Warfarin Understanding the Dose-Effect Relationship". Clinical Pharmacokinetics. Springer International Publishing. 11 (6): 483-504). Genes associated with blood clotting are known in the art (see e.g., US20060166239A1; Litin S C, Gastineau D A (1995) "Current concepts in anticoagulant therapy". Mayo Clin. Proc. 70 (3): 266-72; and Rusdiana et al., Responsiveness to low-dose warfarin associated with genetic variants of VKORC1, CYP2C9, CYP2C19, and CYP4F2 in an Indonesian population. Eur J Clin Pharmacol. 2013 March; 69(3):395-405). Specifically, in the VKORC1 1639 (or 3673) single-nucleotide polymorphism, the common ("wild-type") G allele is replaced by the A allele. People with an A allele (or the "A haplotype") produce less VKORC1 than do those with the G allele (or the "non-A haplotype"). The prevalence of these variants also varies by race, with 37% of Caucasians and 14% of Africans carrying the A allele. The end result is a decreased number of clotting factors and therefore, a decreased ability to clot.

In certain example embodiments, the availability of genetic material for detecting a SNP in a patient allows for detecting SNPs without amplification of a DNA or RNA sample. In the case of genotyping, the biological sample tested is easily obtained. In certain example embodiments, the incubation time of the present invention may be shortened. The assay may be performed in a period of time required for an enzymatic reaction to occur. One skilled in the art can perform biochemical reactions in 5 minutes (e.g., 5 minute ligation). The present invention may use an automated DNA extraction device to obtain DNA from blood. The DNA can then be added to a reaction that generates a target molecule for the effector protein. Immediately upon generating the target molecule the masking agent can be cut and a signal detected. In exemplary embodiments, the present invention allows a POC rapid diagnostic for determining a genotype before administering a drug (e.g., blood thinner). In the case where an amplification step is used, all of the reactions occur in the same reaction in a one step process. In preferred embodiments, the POC assay may be performed in less than an hour, preferably 10 minutes, 20 minutes, 30 minutes, 40 minutes, or 50 minutes.

In certain embodiments, the systems, devices, and methods disclosed herein may be used for detecting the presence or expression level of long non-coding RNAs (lncRNAs). Expression of certain lncRNAs are associated with disease state and/or drug resistance. In particular, certain lncRNAs (e.g., TCONS_00011252, NR_034078, TCONS_00010506, TCONS_00026344, TCONS_00015940, TCONS_00028298, TCONS_00026380, TCONS_0009861, TCONS_00026521, TCONS_00016127, NR_125939, NR_033834, TCONS_00021026, TCONS_00006579, NR_109890, and NR_026873) are associated with resistance to cancer treatment, such as resistance to one or more BRAF inhibitors (e.g., Vemurafenib, Dabrafenib, Sorafenib, GDC-0879, PLX-4720, and LGX818) for treating melanoma (e.g., nodular melanoma, lentigo maligna, lentigo maligna melanoma, acral lentiginous melanoma, superficial spreading melanoma, mucosal melanoma, polypoid melanoma, desmoplastic melanoma, amelanotic melanoma, and soft-tissue melanoma). The detection of lncRNAs using the various embodiments described herein can facilitate disease diagnosis and/or selection of treatment options.

In one embodiment, the present invention can guide DNA- or RNA-targeted therapies (e.g., CRISPR, TALE, Zinc finger proteins, RNAi), particularly in settings where rapid administration of therapy is important to treatment outcomes.

LOH Detection

Cancer cells undergo a loss of genetic material (DNA) when compared to normal cells. This deletion of genetic material which almost all, if not all, cancers undergo is referred to as "loss of heterozygosity" (LOH). Loss of heterozygosity (LOH) is a gross chromosomal event that results in loss of the entire gene and the surrounding chromosomal region. The loss of heterozygosity is a common occurrence in cancer, where it can indicate the absence of a functional tumor suppressor gene in the lost region. However, a loss may be silent because there still is one functional gene left on the other chromosome of the chromosome pair. The remaining copy of the tumor suppressor gene can be inactivated by a point mutation, leading to loss of a tumor suppressor gene. The loss of genetic material from cancer cells can result in the selective loss of one of two or more alleles of a gene vital for cell viability or cell growth at a particular locus on the chromosome.

An "LOH marker" is DNA from a microsatellite locus, a deletion, alteration, or amplification in which, when compared to normal cells, is associated with cancer or other diseases. An LOH marker often is associated with loss of a tumor suppressor gene or another, usually tumor related, gene.

The term "microsatellites" refers to short repetitive sequences of DNA that are widely distributed in the human genome. A microsatellite is a tract of tandemly repeated (i.e. adjacent) DNA motifs that range in length from two to five nucleotides, and are typically repeated 5-50 times. For example, the sequence TATATATATA (SEQ ID NO: 135) is a dinucleotide microsatellite, and GTCGTCGTCGTCGTC (SEQ ID NO: 136) is a trinucleotide microsatellite (with A being Adenine, G Guanine, C Cytosine, and T Thymine). Somatic alterations in the repeat length of such microsatellites have been shown to represent a characteristic feature of tumors. Guide RNAs may be designed to detect such microsatellites. Furthermore, the present invention may be used to detect alterations in repeat length, as well as amplifications and deletions based upon quantitation of the detectable signal. Certain microsatellites are located in regulatory flanking or intronic regions of genes, or directly in codons of genes. Microsatellite mutations in such cases can lead to phenotypic changes and diseases, notably in triplet expansion diseases such as fragile X syndrome and Huntington's disease.

Frequent loss of heterozygosity (LOH) on specific chromosomal regions has been reported in many kinds of malignancies. Allelic losses on specific chromosomal regions are the most common genetic alterations observed in a variety of malignancies, thus microsatellite analysis has been applied to detect DNA of cancer cells in specimens from body fluids, such as sputum for lung cancer and urine for bladder cancer. (Rouleau, et al. Nature 363, 515-521 (1993); and Latif, et al. Science 260, 1317-1320 (1993)). Moreover, it has been established that markedly increased concentrations of soluble DNA are present in plasma of individuals with cancer and some other diseases, indicating that cell free serum or plasma can be used for detecting cancer DNA with microsatellite abnormalities. (Kamp, et al. Science 264, 436-440 (1994); and Steck, et al. Nat Genet. 15(4), 356-362 (1997)). Two groups have reported microsatellite alterations in plasma or serum of a limited number of patients with small cell lung cancer or head and neck cancer. (Hahn, et al. Science 271, 350-353 (1996); and Miozzo, et al. Cancer Res. 56, 2285-2288 (1996)). Detection of loss of heterozygosity in tumors and serum of melanoma patients has also been previously shown (see, e.g., United States patent number U.S. Pat. No. 6,465,177B 1).

Thus, it is advantageous to detect LOH markers in a subject suffering from or at risk of cancer. The present invention may be used to detect LOH in tumor cells. In one embodiment, circulating tumor cells may be used as a biological sample. In preferred embodiments, cell free DNA obtained from serum or plasma is used to noninvasively detect and/or monitor LOH. In other embodiments, the biological sample may be any sample described herein (e.g., a urine sample for bladder cancer). Not being bound by a theory, the present invention may be used to detect LOH markers with improved sensitivity as compared to any prior method, thus providing early detection of mutational events. In one embodiment, LOH is detected in biological fluids, wherein the presence of LOH is associated with the occurrence of cancer. The method and systems described herein represent a significant advance over prior techniques, such as PCR or tissue biopsy by providing a non-invasive, rapid, and accurate method for detecting LOH of specific alleles associated with cancer. Thus, the present invention provides methods and systems which can be used to screen high-risk populations and to monitor high risk patients undergoing chemoprevention, chemotherapy, immunotherapy or other treatments.

Because the method of the present invention requires only DNA extraction from bodily fluid such as blood, it can be performed at any time and repeatedly on a single patient. Blood can be taken and monitored for LOH before or after surgery; before, during, and after treatment, such as chemotherapy, radiation therapy, gene therapy or immunotherapy; or during follow-up examination after treatment for disease progression, stability, or recurrence. Not being bound by a theory, the method of the present invention also may be used to detect subclinical disease presence or recurrence with an LOH marker specific for that patient since LOH markers are specific to an individual patient's tumor. The method also can detect if multiple metastases may be present using tumor specific LOH markers.

Detection of Epigenetic Modifications

Histone variants, DNA modifications, and histone modifications indicative of cancer or cancer progression may be used in the present invention. For example, U.S. patent publication 20140206014 describes that cancer samples had elevated nucleosome H2AZ, macroH2A1.1, 5-methylcytosine, P-H2AX(Ser139) levels as compared to healthy subjects. The presence of cancer cells in an individual may generate a higher level of cell free nucleosomes in the blood as a result of the increased apoptosis of the cancer cells. In one embodiment, an antibody directed against marks associated with apoptosis, such as H2B Ser 14(P), may be used to identify single nucleosomes that have been released from apoptotic neoplastic cells. Thus, DNA arising from tumor cells may be advantageously analyzed according to the present invention with high sensitivity and accuracy.

Pre-Natal Screening

In certain embodiments, the method and systems of the present invention may be used in prenatal screening. In certain embodiments, cell-free DNA is used in a method of prenatal screening. In certain embodiments, DNA associated with single nucleosomes or oligonucleosomes may be detected with the present invention. In preferred embodiments, detection of DNA associated with single nucleosomes or oligonucleosomes is used for prenatal screening. In certain embodiments, cell-free chromatin fragments are used in a method of prenatal screening.

Prenatal diagnosis or prenatal screening refers to testing for diseases or conditions in a fetus or embryo before it is born. The aim is to detect birth defects such as neural tube defects, Down syndrome, chromosome abnormalities, genetic disorders and other conditions, such as spina bifida, cleft palate, Tay Sachs disease, sickle cell anemia, thalassemia, cystic fibrosis, Muscular dystrophy, and fragile X syndrome. Screening can also be used for prenatal sex discernment. Common testing procedures include amniocentesis, ultrasonography including nuchal translucency ultrasound, serum marker testing, or genetic screening. In some cases, the tests are administered to determine if the fetus will be aborted, though physicians and patients also find it useful to diagnose high-risk pregnancies early so that delivery can be scheduled in a tertiary care hospital where the baby can receive appropriate care.

It has been realized that there are fetal cells which are present in the mother's blood, and that these cells present a potential source of fetal chromosomes for prenatal DNA-based diagnostics. Additionally, fetal DNA ranges from about 2-10% of the total DNA in maternal blood. Currently available prenatal genetic tests usually involve invasive procedures. For example, chorionic villus sampling (CVS) performed on a pregnant woman around 10-12 weeks into the pregnancy and amniocentesis performed at around 14-16 weeks all involve invasive procedures to obtain the sample for testing chromosomal abnormalities in a fetus. Fetal cells obtained via these sampling procedures are usually tested for chromosomal abnormalities using cytogenetic or fluorescent in situ hybridization (FISH) analyses. Cell-free fetal DNA has been shown to exist in plasma and serum of pregnant women as early as the sixth week of gestation, with concentrations rising during pregnancy and peaking prior to parturition. Because these cells appear very early in the pregnancy, they could form the basis of an accurate, non-invasive, first trimester test. Not being bound by a theory, the present invention provides unprecedented sensitivity in detecting low amounts of fetal DNA. Not being bound by a theory, abundant amounts of maternal DNA are generally concomitantly recovered along with the fetal DNA of interest, thus decreasing sensitivity in fetal DNA quantification and mutation detection. The present invention overcomes such problems by the unexpectedly high sensitivity of the assay.

The H3 class of histones consists of four different protein types: the main types, H3.1 and H3.2; the replacement type, H3.3; and the testis specific variant, H3t. Although H3.1 and H3.2 are closely related, only differing at Ser96, H3.1 differs from H3.3 in at least 5 amino acid positions. Further, H3.1 is highly enriched in fetal liver, in comparison to its presence in adult tissues including liver, kidney and heart. In adult human tissue, the H3.3 variant is more abundant than the H3.1 variant, whereas the converse is true for fetal liver. The present invention may use these differences to detect fetal nucleosomes and fetal nucleic acid in a maternal biological sample that comprises both fetal and maternal cells and/or fetal nucleic acid.

In one embodiment, fetal nucleosomes may be obtained from blood. In other embodiments, fetal nucleosomes are obtained from a cervical mucus sample. In certain embodiments, a cervical mucus sample is obtained by swabbing or lavage from a pregnant woman early in the second trimester or late in the first trimester of pregnancy. The sample may be placed in an incubator to release DNA trapped in mucus. The incubator may be set at 37° C. The sample may be rocked for approximately 15 to 30 minutes. Mucus may be further dissolved with a mucinase for the purpose of releasing DNA. The sample may also be subjected to conditions, such as chemical treatment and the like, as well known in the art, to induce apoptosis to release fetal nucleosomes. Thus, a cervical mucus sample may be treated with an agent that induces apoptosis, whereby fetal nucleosomes are released. Regarding enrichment of circulating fetal DNA, reference is made to U.S. patent publication Nos. 20070243549 and 20100240054. The present invention is especially advantageous when applying the methods and systems to prenatal screening where only a small fraction of nucleosomes or DNA may be fetal in origin.

Prenatal screening according to the present invention may be for a disease including, but not limited to Trisomy 13, Trisomy 16, Trisomy 18, Klinefelter syndrome (47, XXY), (47, XYY) and (47, XXX), Turner syndrome, Down syndrome (Trisomy 21), Cystic Fibrosis, Huntington's Disease, Beta Thalassaemia, Myotonic Dystrophy, Sickle Cell Anemia, *Porphyria*, Fragile-X-Syndrome, Robertsonian translocation, Angelman syndrome, DiGeorge syndrome and Wolf-Hirschhorn Syndrome.

Several further aspects of the invention relate to diagnosing, prognosing and/or treating defects associated with a wide range of genetic diseases which are further described on the website of the National Institutes of Health under the topic subsection Genetic Disorders (website at health.nih.gov/topic/Genetic Disorders).

Cancer and Cancer Drug Resistance Detection

In certain embodiments, the present invention may be used to detect genes and mutations associated with cancer. In certain embodiments, mutations associated with resistance are detected. The amplification of resistant tumor cells or appearance of resistant mutations in clonal populations of tumor cells may arise during treatment (see, e.g., Burger J A, et al., Clonal evolution in patients with chronic lymphocytic leukaemia developing resistance to BTK inhibition. Nat Commun. 2016 May 20; 7:11589; Landau D A, et al., Mutations driving CLL and their evolution in progression and relapse. Nature. 2015 Oct. 22; 526(7574):525-30; Landau D A, et al., Clonal evolution in hematological malignancies and therapeutic implications. Leukemia. 2014 January; 28(1):34-43; and Landau D A, et al., Evolution and impact of subclonal mutations in chronic lymphocytic leukemia. Cell. 2013 Feb. 14; 152(4):714-26). Accordingly, detecting such mutations requires highly sensitive assays and monitoring requires repeated biopsy. Repeated biopsies are inconvenient, invasive and costly. Resistant mutations can be difficult to detect in a blood sample or other noninvasively collected biological sample (e.g., blood, saliva, urine) using the prior methods known in the art. Resistant mutations may refer to mutations associated with resistance to a chemotherapy, targeted therapy, or immunotherapy.

In certain embodiments, mutations occur in individual cancers that may be used to detect cancer progression. In one embodiment, mutations related to T cell cytolytic activity against tumors have been characterized and may be detected by the present invention (see e.g., Rooney et al., Molecular and genetic properties of tumors associated with local immune cytolytic activity, Cell. 2015 January 15; 160(1-2): 48-61). Personalized therapies may be developed for a patient based on detection of these mutations (see e.g., WO2016100975A1). In certain embodiments, cancer specific mutations associated with cytolytic activity may be a mutation in a gene selected from the group consisting of CASP8, B2M, PIK3CA, SMC1A, ARID5B, TET2, ALPK2, COL5A1, TP53, DNER, NCOR1, MORC4, CIC, IRF6, MYOCD, ANKLE1, CNKSR1, NF1, SOS1, ARID2, CUL4B, DDX3X, FUBP1, TCP11L2, HLA-A, B or C, CSNK2A1, MET, ASXL1, PD-L1, PD-L2, IDO1, IDO2, ALOX12B and ALOX15B, or copy number gain, excluding whole-chromosome events, impacting any of the following chromosomal bands: 6q16.1-q21, 6q22.31-q24.1, 6q25.1-q26, 7p11.2-q11.1, 8p23.1, 8p11.23-p11.21 (containing IDO1, IDO2), 9p24.2-p23 (containing PDL1, PDL2), 10p15.3, 10p15.1-p13, 11p14.1, 12p13.32-p3.2, 17p13.1 (containing ALOX12B, ALOX15B), and 22q11.1-q11.21.

In certain embodiments, the present invention is used to detect a cancer mutation (e.g., resistance mutation) during the course of a treatment and after treatment is completed. The sensitivity of the present invention may allow for noninvasive detection of clonal mutations arising during treatment and can be used to detect a recurrence in the disease.

In certain example embodiments, detection of microRNAs (miRNA) and/or miRNA signatures of differentially expressed miRNA, may be used to detect or monitor progression of a cancer and/or detect drug resistance to a cancer therapy. As an example, Nadal et al. (Nature Scientific Reports, (2015) doi:10.1038/srep12464) describe mRNA signatures that may be used to detect non-small cell lung cancer (NSCLC).

In certain example embodiments, the presence of resistance mutations in clonal subpopulations of cells may be used in determining a treatment regimen. In other embodiments, personalized therapies for treating a patient may be administered based on common tumor mutations. In certain embodiments, common mutations arise in response to treatment and lead to drug resistance. In certain embodiments, the present invention may be used in monitoring patients for cells acquiring a mutation or amplification of cells harboring such drug resistant mutations.

Treatment with various chemotherapeutic agents, particularly with targeted therapies such as tyrosine kinase inhibitors, frequently leads to new mutations in the target molecules that resist the activity of the therapeutic. Multiple strategies to overcome this resistance are being evaluated, including development of second generation therapies that are not affected by these mutations and treatment with multiple agents including those that act downstream of the resistance mutation. In an exemplary embodiment, a common mutation to ibrutinib, a molecule targeting Bruton's Tyrosine Kinase (BTK) and used for CLL and certain lymphomas, is a Cysteine to Serine change at position 481 (BTK/C481S). Erlotinib, which targets the tyrosine kinase domain of the Epidermal Growth Factor Receptor (EGFR), is commonly used in the treatment of lung cancer and resistant tumors invariably develop following therapy. A common mutation found in resistant clones is a threonine to methionine mutation at position 790.

Non-silent mutations shared between populations of cancer patients and common resistant mutations that may be detected with the present invention are known in the art (see e.g., WO/2016/187508). In certain embodiments, drug resistance mutations may be induced by treatment with ibrutinib, erlotinib, imatinib, gefitinib, crizotinib, trastuzumab, vemurafenib, RAF/MEK, check point blockade therapy, or anti-estrogen therapy. In certain embodiments, the cancer specific mutations are present in one or more genes encoding a protein selected from the group consisting of Programmed Death-Ligand 1 (PD-L1), androgen receptor (AR), Bruton's Tyrosine Kinase (BTK), Epidermal Growth Factor Receptor (EGFR), BCR-Abl, c-kit, PIK3CA, HER2, EML4-ALK, KRAS, ALK, ROS1, AKT1, BRAF, MEK1, MEK2, NRAS, RAC1, and ESR1.

Immune checkpoints are inhibitory pathways that slow down or stop immune reactions and prevent excessive tissue damage from uncontrolled activity of immune cells. In certain embodiments, the immune checkpoint targeted is the programmed death-1 (PD-1 or CD279) gene (PDCD1). In other embodiments, the immune checkpoint targeted is cytotoxic T-lymphocyte-associated antigen (CTLA-4). In additional embodiments, the immune checkpoint targeted is another member of the CD28 and CTLA4 Ig superfamily such as BTLA, LAG3, ICOS, PDL1 or KIR. In further additional embodiments, the immune checkpoint targeted is a member of the TNFR superfamily such as CD40, OX40, CD137, GITR, CD27 or TIM-3.

Recently, gene expression in tumors and their microenvironments have been characterized at the single cell level (see e.g., Tirosh, et al. Dissecting the multicellular ecosystem of metastatic melanoma by single cell RNA-seq. Science 352, 189-196, doi:10.1126/science.aad0501 (2016)); Tirosh et al., Single-cell RNA-seq supports a developmental hierarchy in human oligodendroglioma. Nature. 2016 Nov. 10; 539(7628):309-313. doi: 10.1038/nature20123. Epub 2016 Nov. 2; and International patent publication serial number WO 2017004153 A1). In certain embodiments, gene signatures may be detected using the present invention. In one embodiment complement genes are monitored or detected in a tumor microenvironment. In one embodiment MITF and AXL programs are monitored or detected. In one embodiment, a tumor specific stem cell or progenitor cell signature is detected. Such signatures indicate the state of an immune response and state of a tumor. In certain embodiments, the state of a tumor in terms of proliferation, resistance to treatment and abundance of immune cells may be detected.

Thus, in certain embodiments, the invention provides low-cost, rapid, multiplexed cancer detection panels for circulating DNA, such as tumor DNA, particularly for monitoring disease recurrence or the development of common resistance mutations.

Immunotherapy Applications

The embodiments disclosed herein can also be useful in further immunotherapy contexts. For instance, in some embodiments methods of diagnosing, prognosing and/or staging an immune response in a subject comprise detecting a first level of expression, activity and/or function of one or more biomarker and comparing the detected level to a control level wherein a difference in the detected level and the control level indicates the presence of an immune response in the subject.

In certain embodiments, the present invention may be used to determine dysfunction or activation of tumor infiltrating lymphocytes (TIL). TILs may be isolated from a tumor using known methods. The TILs may be analyzed to determine whether they should be used in adoptive cell transfer therapies. Additionally, chimeric antigen receptor T cells (CAR T cells) may be analyzed for a signature of dysfunction or activation before administering them to a subject. Exemplary signatures for dysfunctional and activated T cells have been described (see e.g., Singer M, et al., A Distinct Gene Module for Dysfunction Uncoupled from Activation in Tumor-Infiltrating T Cells. Cell. 2016 Sep. 8; 166(6):1500-1511.e9. doi: 10.1016/j.cell.2016.08.052).

In some embodiments, C2c2 is used to evaluate that state of immune cells, such as T cells (e.g., CD8+ and/or CD4+ T cells). In particular, T cell activation and/or dysfunction can be determined, e.g., based on genes or gene signatures associated with one or more of the T cell states. In this way, C2c2 can be used to determine the presence of one or more subpopulations of T cells.

In some embodiments, C2c2 can be used in a diagnostic assay or may be used as a method of determining whether a patient is suitable for administering an immunotherapy or another type of therapy. For example, detection of gene or biomarker signatures may be performed via C2c2 to determine whether a patient is responding to a given treatment or, if the patient is not responding, if this may be due to T cell dysfunction. Such detection is informative regarding the types of therapy the patient is best suited to receive. For example, whether the patient should receive immunotherapy.

In some embodiments, the systems and assays disclosed herein may allow clinicians to identify whether a patient's response to a therapy (e.g., an adoptive cell transfer (ACT) therapy) is due to cell dysfunction, and if it is, levels of up-regulation and down-regulation across the biomarker signature will allow problems to be addressed. For example, if a patient receiving ACT is non-responsive, the cells administered as part of the ACT may be assayed by an assay disclosed herein to determine the relative level of expression of a biomarker signature known to be associated with cell activation and/or dysfunction states. If a particular inhibitory receptor or molecule is up-regulated in the ACT cells, the patient may be treated with an inhibitor of that receptor or molecule. If a particular stimulatory receptor or molecule is down-regulated in the ACT cells, the patient may be treated with an agonist of that receptor or molecule.

In certain example embodiments, the systems, methods, and devices described herein may be used to screen gene signatures that identify a particular cell type, cell phenotype, or cell state. Likewise, through the use of such methods as compressed sensing, the embodiments disclosed herein may be used to detect transcriptomes. Gene expression data are highly structured, such that the expression level of some genes is predictive of the expression level of others. Knowledge that gene expression data are highly structured allows for the assumption that the number of degrees of freedom in the system are small, which allows for assuming that the basis for computation of the relative gene abundancies is sparse. It is possible to make several biologically motivated assumptions that allow Applicants to recover the nonlinear interaction terms while under-sampling without having any specific knowledge of which genes are likely to interact. In particular, if Applicants assume that genetic interactions are low rank, sparse, or a combination of these, then the true number of degrees of freedom is small relative to the complete combinatorial expansion, which enables Applicants to infer the full nonlinear landscape with a relatively small number of perturbations. Working around these assumptions, analytical theories of matrix completion and compressed sensing may be used to design under-sampled combinatorial perturbation experiments. In addition, a kernel-learning framework may be used to employ under-sampling by building predictive functions of combinatorial perturbations without directly learning any individual interaction coefficient. Compressed sensing provides a way to identify the minimal number of target transcripts to be detected in order to obtain a comprehensive gene-expression profile. Methods for compressed sensing are disclosed in PCT/US2016/059230 "Systems and Methods for Determining Relative Abundances of Biomolecules" filed Oct. 27, 2016, which is incorporated herein by reference. Having used methods like compressed sensing to identify a minimal transcript target set, a set of corresponding guide RNAs may then be designed to detect said transcripts. Accordingly, in certain example embodiments, a method for obtaining a gene-expression profile of a cell comprises detecting, using the embodiments disclosed herein, a minimal transcript set that provides a gene-expression profile of a cell or population of cells.

Detecting Nucleic Acid Tagged Items

Alternatively, the embodiments described herein may be used to detect nucleic acid identifiers. Nucleic acid identifiers are non-coding nucleic acids that may be used to identify a particular article. Example nucleic acid identifiers, such as DNA watermarks, are described in Heider and Barnekow. "DNA watermarks: A proof of concept" BMC Molecular Biology 9:40 (2008). The nucleic acid identifiers may also be a nucleic acid barcode. A nucleic-acid based barcode is a short sequence of nucleotides (for example, DNA, RNA, or combinations thereof) that is used as an identifier for an associated molecule, such as a target molecule and/or target nucleic acid. A nucleic acid barcode can have a length of at least, for example, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 60, 70, 80, 90, or 100 nucleotides, and can be in single- or double-stranded form. One or more nucleic acid barcodes can be attached, or "tagged," to a target molecule and/or target nucleic acid. This attachment can be direct (for example, covalent or non-covalent binding of the barcode to the target molecule) or indirect (for example, via an additional molecule, for example, a specific binding agent, such as an antibody (or other protein) or a barcode receiving adaptor (or other nucleic acid molecule). Target molecule and/or target nucleic acids can be labeled with multiple nucleic acid barcodes in combinatorial fashion, such as a nucleic acid barcode concatemer. Typically, a nucleic acid barcode is used to identify a target molecule and/or target nucleic acids as being from a particular compartment (for example a discrete volume), having a particular physical property (for example, affinity, length, sequence, etc.), or having been subject to certain treatment conditions. Target molecules and/or target nucleic acids can be associated with multiple nucleic acid barcodes to provide information about all of these features (and more). Methods of generating nucleic acid-barcodes are disclosed, for example, in International Patent Application Publication No. WO/2014/047561.

Enzymes

The application further provides orthologs of C2c2 which demonstrate robust activity making them particularly suitable for different applications of RNA cleavage and detection. These applications include but are not limited to those described herein. More particularly, an ortholog which is demonstrated to have stronger activity than others tested is the C2c2 ortholog identified from the organism *Leptotrichia wadei* (LwC2c2). The application thus provides methods for modifying a target locus of interest, comprising delivering to said locus a non-naturally occurring or engineered composition comprising a C2c2 effector protein, more particularly a C2c2 effector protein with increased activity as described herein and one or more nucleic acid components, wherein at least the one or more nucleic acid components is engineered, the one or more nucleic acid components directs the complex to the target of interest and the effector protein forms a complex with the one or more nucleic acid components and the complex binds to the target locus of interest. In particular embodiments, the target locus of interest comprises RNA. The application further provides for the use of the C2c2 effector proteins with increased activity in RNA sequence specific interference, RNA sequence specific gene regulation, screening of RNA or RNA products or lincRNA or non-coding RNA, or nuclear RNA, or mRNA, mutagenesis, Fluorescence in situ hybridization, or breeding.

EXAMPLES

Example 1—Increasing Cas13 Activity with Additional Crispr-Associated Proteins

Figure 5:
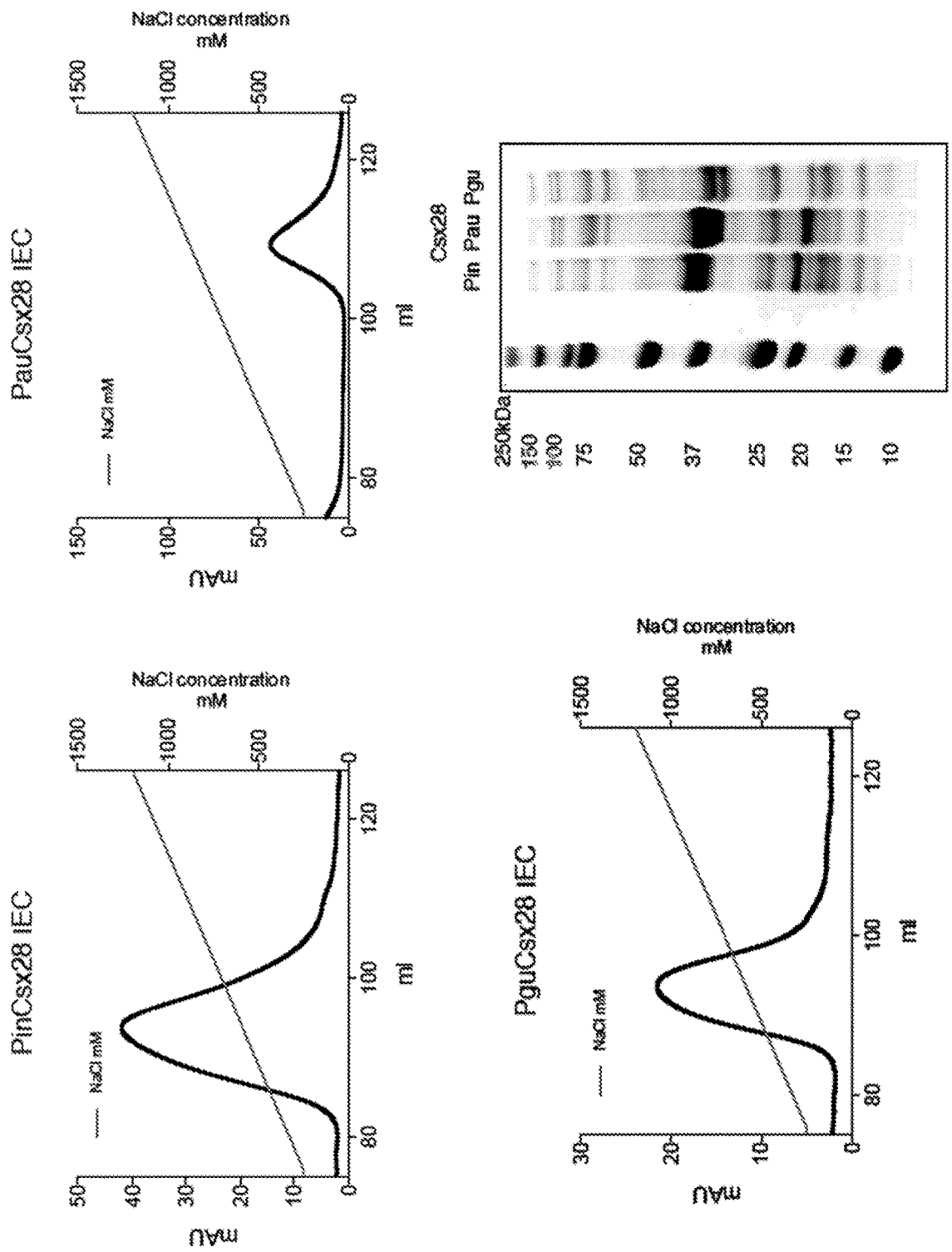
FIG. 5—Protein purification of Csx28 orthologs. Chromatograms of ion exchange chromatography (IEC) for PinCsx28, PauCsx28, and PguCsx28 used in this study. Measured UV absorbance (mAU) is shown against the elution volume (ml). The red line is showing the increasing NaCl concentration used for protein elution. SDS PAGE of concentrated Csx28 orthologs is shown for PinCsx28, PauCsx28, and PguCsx28.
Figure 6:
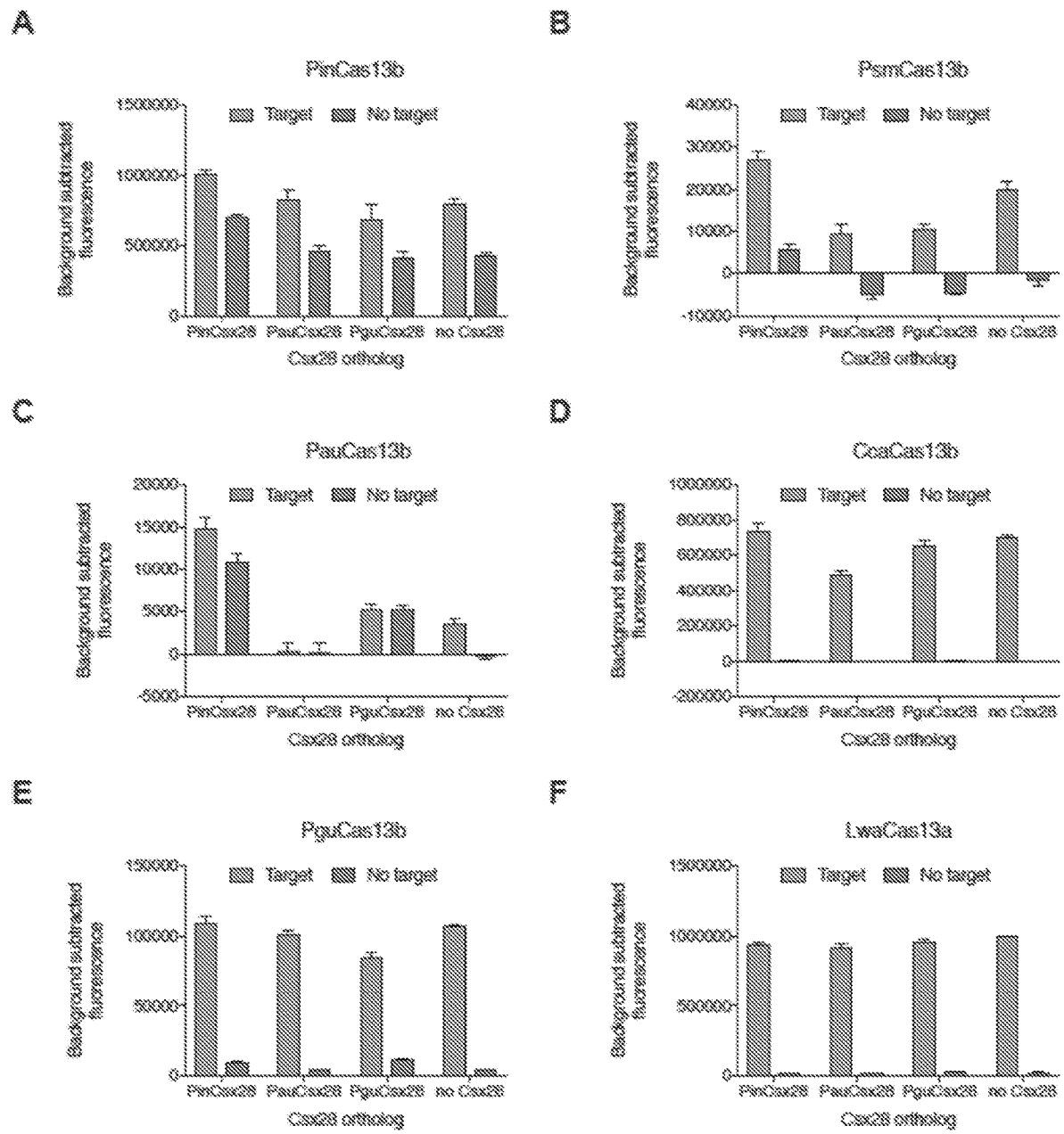
FIG. 6—Effects of Csx28 co-incubation on Cas13 cleavage activity. (A) Cleavage activity of PinCas13b co-incubated with PinCsx28, PauCsx28, PguCsx28, or no Csx28. (B) Cleavage activity of PsmCas13b co-incubated with PinCsx28, PauCsx28, PguCsx28, or no Csx28. (C) Cleavage activity of PauCas13b co-incubated with PinCsx28, PauCsx28, PguCsx28, or no Csx28. (D) Cleavage activity of CcaCas13b co-incubated with PinCsx28, PauCsx28, PguCsx28, or no Csx28. (E) Cleavage activity of PguCas13b co-incubated with PinCsx28, PauCsx28, PguCsx28, or no Csx28. (F) Cleavage activity of LwaCas13a co-incubated with PinCsx28, PauCsx28, PguCsx28, or no Csx28.

CRISPR effectors often interact with additional components to modulate activity, and Applicants sought to leverage these interactions to increase the sensitivity and speed of SHERLOCK. Type VI-B CRISPR systems often harbor the interference-modulating proteins Csx27 and Csx28, and Csx28 co-expression has been demonstrated to increase the interference activity of Cas13b proteins in vivo, implying that they may be capable of increasing endonuclease activity of Cas13b in vitro. As Csx28 was unstable in our hands, Applicants purified Csx28-Sumo fusion proteins from three Type VI-B systems (FIG. 5A) and tested whether Csx28 supplementation increased activity of Cas13a and Cas13b proteins. Applicants found that Csx28 proteins either decreased the activity of Cas13 or increased the target-independent cleavage (FIG. 6A-F).

Example 2—Characterization of Csm6 Cleavage Activity

Figure 10:
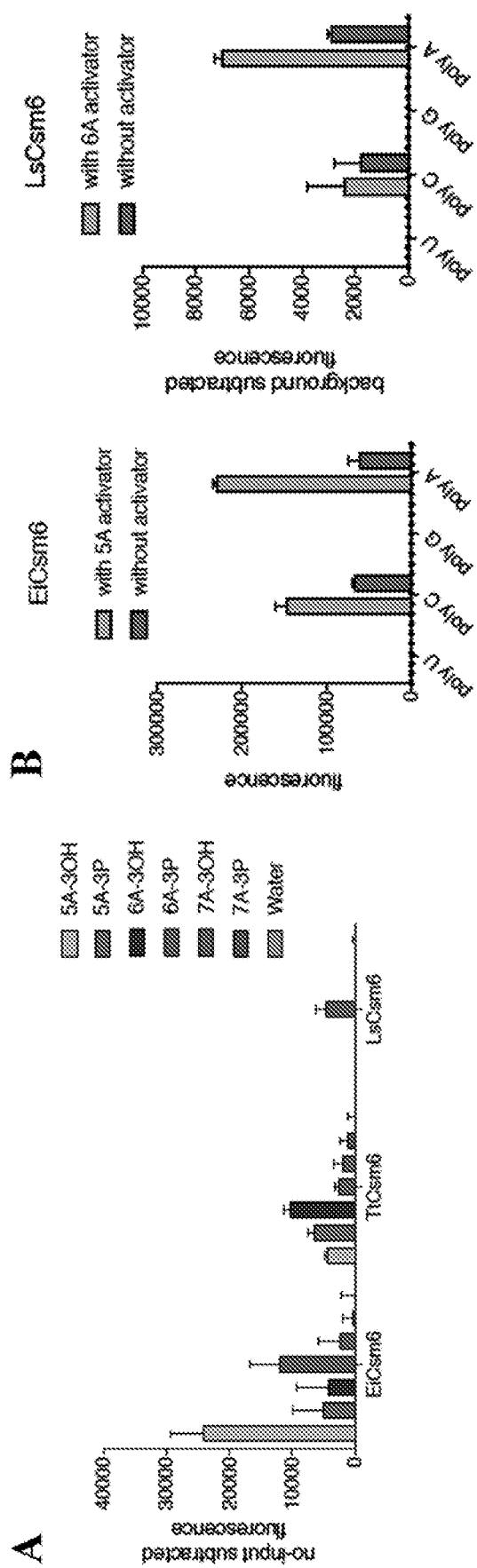
FIG. 10—Evaluation of EiCsm6, TtCsm6, and LsCsm6 activity using activators of different lengths and different 3' end groups. (A) Evaluation of EiCsm6, TtCsm6, and LsCsm6 cleavage activity using adenine oligomers 5-7 nucleotides in length with either 3' OH or 3' phosphate ends. Cleavage activity is measured using the fluorescent RNase alert sensor. (B) Base preference of EiCsm6 and LsCsm6 stimulated with 3' OH adenine oligomers of length 5 nt and 6 nt, respectively. Fluorescent homopolymer sensors used for detection of RNase activity are 5 nt long.
Figure 11:
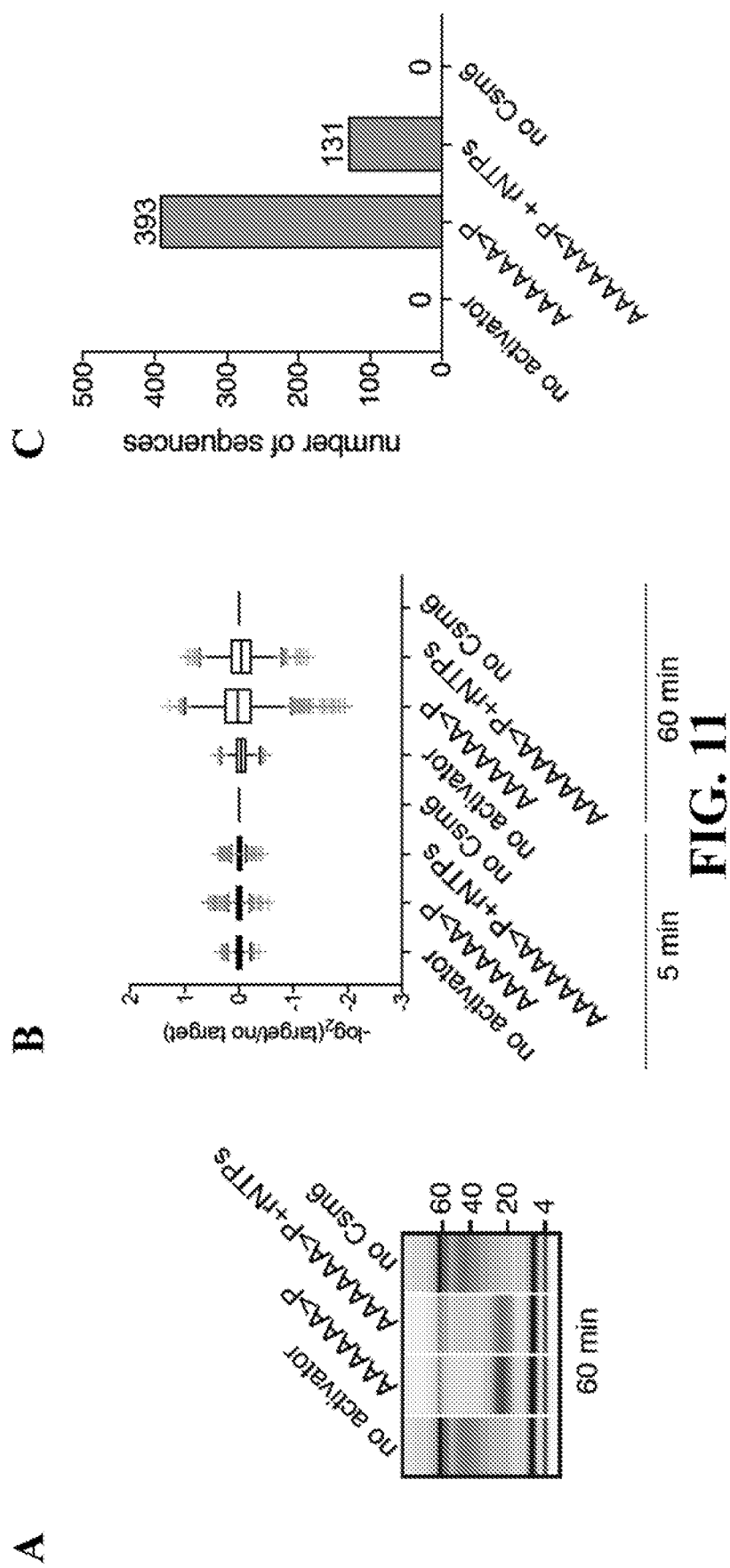
FIG. 11—Size analysis and representation of various motifs after Csm6 cleavage. (A) Bioanalyzer traces for EiCsm6 samples showing changes in library size after RNase activity that is activator dependent. (B) Box plots showing motif distribution of target to non-target motif ratios for Csm6, Csm6 with activator, Csm6 with activator and rNTPs, or background library at 5 minute and 60 minute timepoints. (C) Number of depleted motifs for Csm6, Csm6 with activator, Csm6 with activator and rNTPs, or background library at the 60 minute timepoint.
Figure 12:
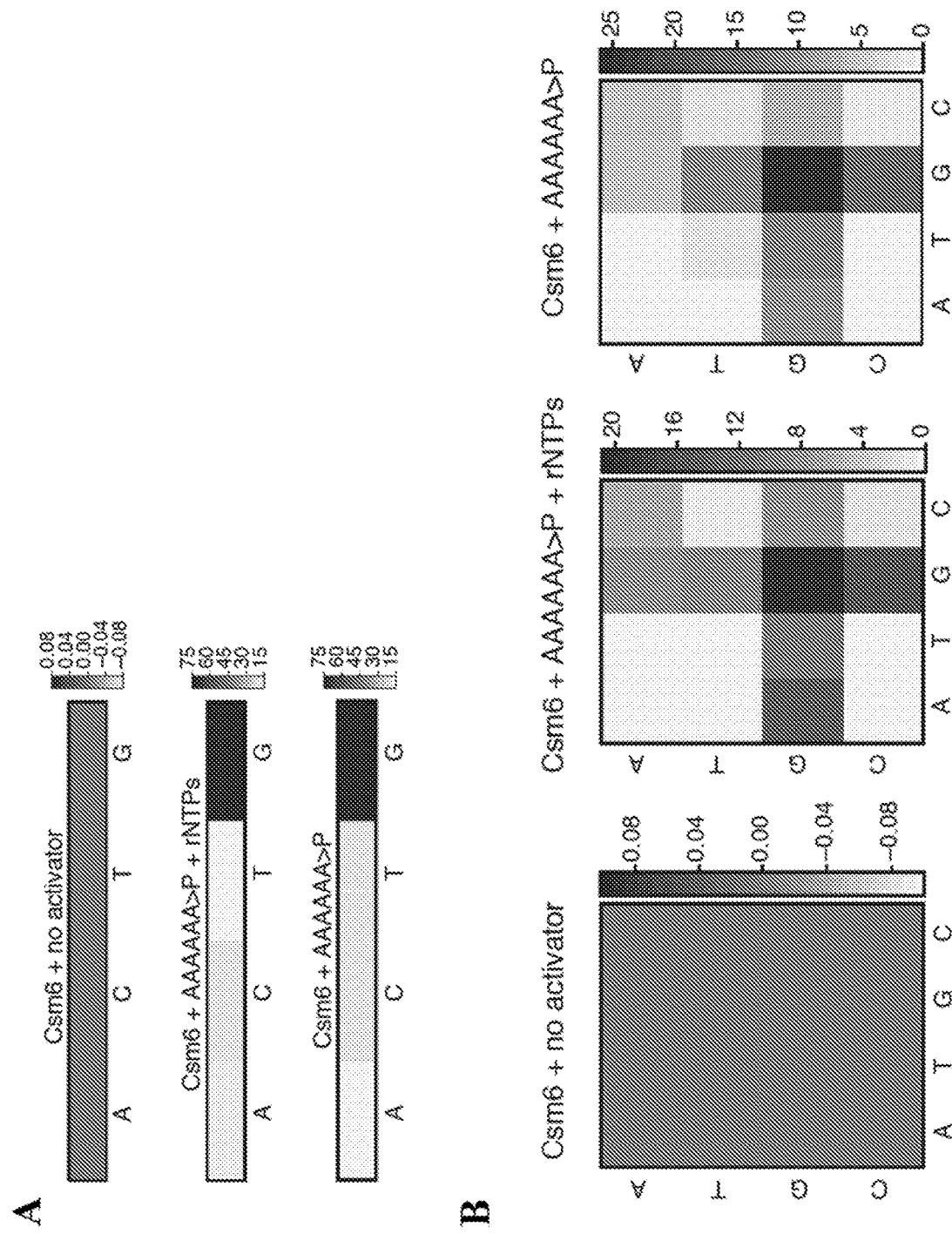
FIG. 12—Single- and two-base preferences of Csm6 conditions determined by random motif library screen. (A) Heatmaps showing single base preferences for Csm6, Csm6 with activator, and Csm6 with activator and rNTPs at the 60 minute timepoint as determined by the random motif library cleavage screen. Values represented in the heatmap are the counts of each single-base across all depleted motifs. Motifs are considered depleted if the $-\log_2$(target/no target) value is above 0.5. In the $-\log_2$(target/no target) value, target and no target denote the frequency of a motif in the target and no target conditions, respectively. (B) Heatmaps showing two-base preferences for Csm6, Csm6 with activator, and Csm6 with activator and rNTPs at the 60 minute timepoint as determined by the random motif library cleavage screen. Values represented in the heatmap are the counts of each two-base across all depleted motifs. Motifs are considered depleted if the $-\log_2$(target/no target) value is above 0.5. In the $-\log_2$(target/no target) value, target and no target denote the frequency of a motif in the target and no target conditions, respectively.
Figure 13:
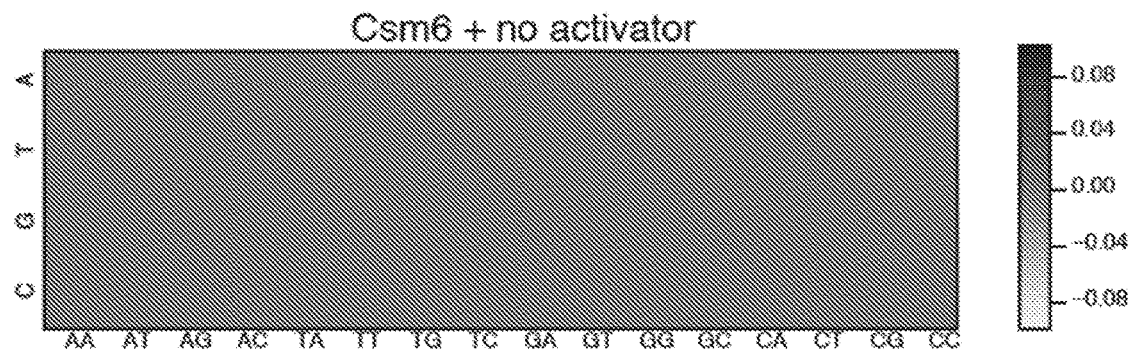
FIG. 13—Three-base preferences of Csm6 conditions determined by random motif library screen. (A) Heatmaps showing three-base preferences for Csm6 at the 60 minute timepoint as determined by the random motif library cleavage screen. Values represented in the heatmap are the counts of each three-base across all depleted motifs. Motifs are considered depleted if the $-\log_2$(target/no target) value is above 0.5. In the $-\log_2$(target/no target) value, target and no target denote the frequency of a motif in the target and no target conditions, respectively. (B) Heatmaps showing three-base preferences for Csm6 with activator at the 60 minute timepoint as determined by the random motif library cleavage screen. Values represented in the heatmap are the counts of each three-base across all depleted motifs. Motifs are considered depleted if the $-\log_2$(target/no target) value is above 0.5. In the –log$_2$(target/no target) value, target and no target denote the frequency of a motif in the target and no target conditions, respectively. (C) Heatmaps showing three-base preferences for Csm6 with activator and rNTPs at the 60 minute timepoint as determined by the random motif library cleavage screen. Values represented in the heatmap are the counts of each three-base across all depleted motifs. Motifs are considered depleted if the –log$_2$(target/no target) value is above 0.5. In the –log$_2$(target/no target) value, target and no target denote the frequency of a motif in the target and no target conditions, respectively.
Figure 13:
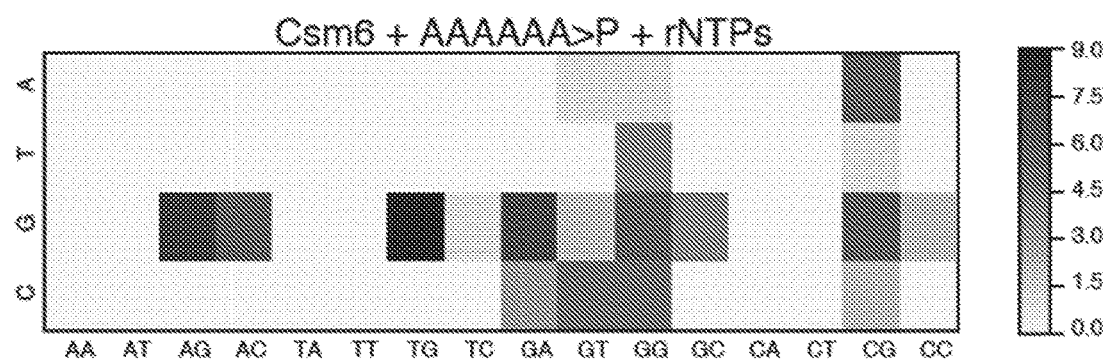
Figure 13:
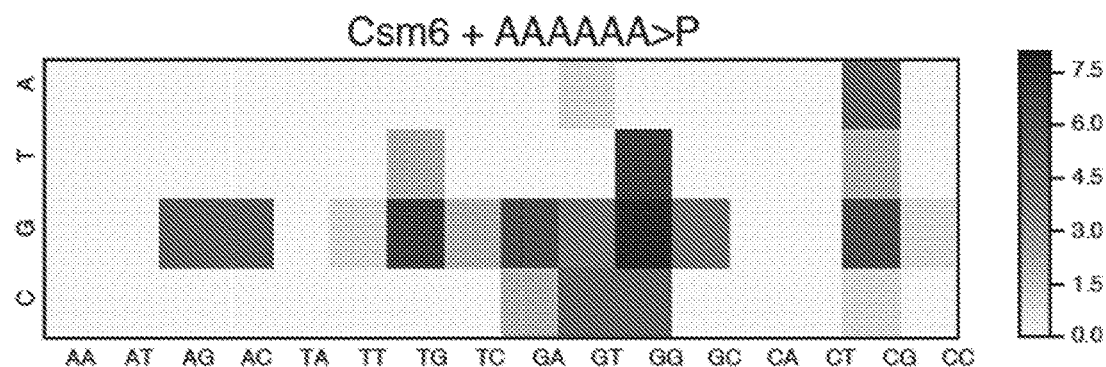
Figure 14:
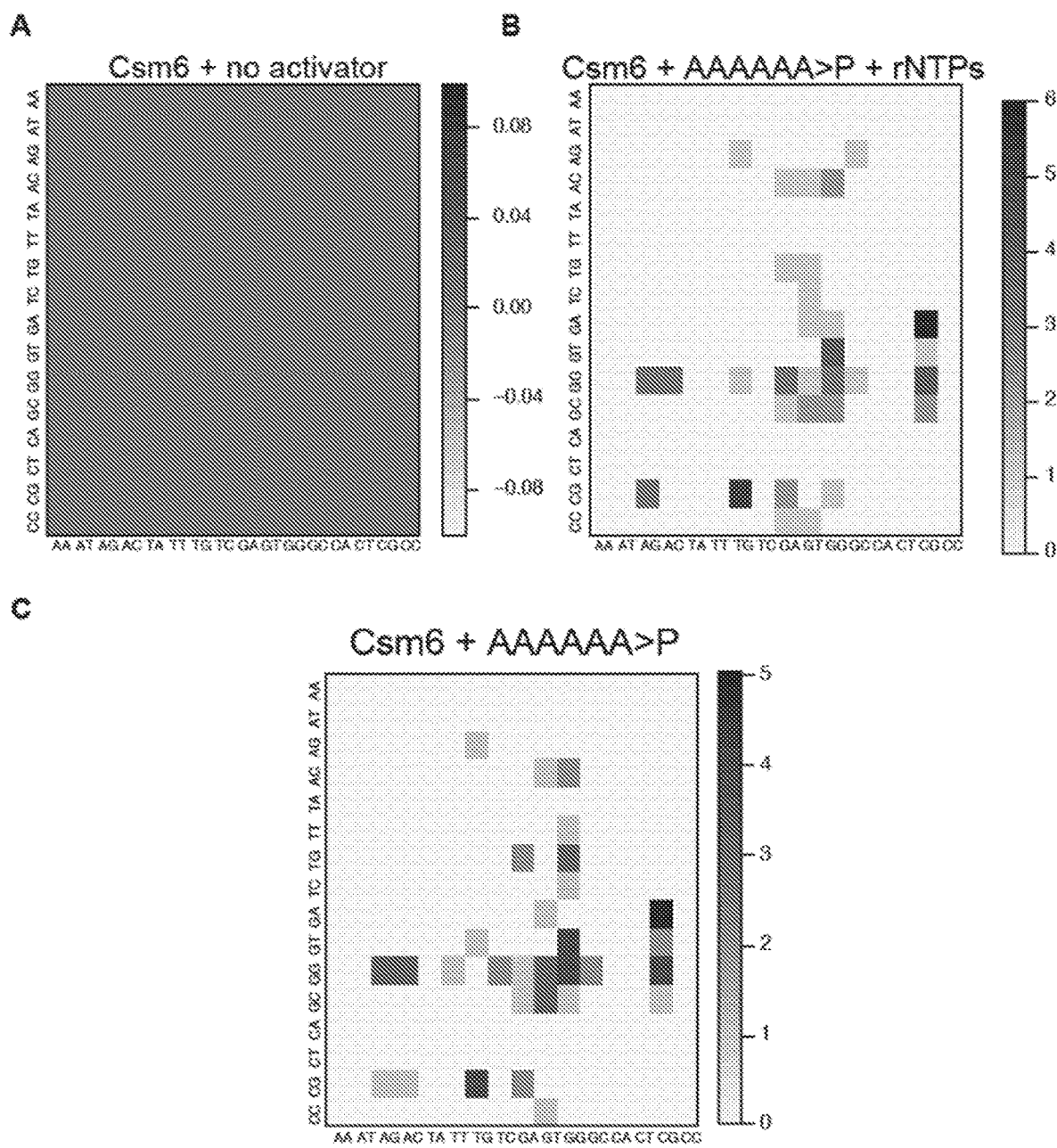
FIG. 14—Single- and two-base preferences of Csm6 conditions determined by random motif library screen. (A) Heatmaps showing four-base preferences for Csm6 at the 60 minute timepoint as determined by the random motif library cleavage screen. Values represented in the heatmap are the counts of each four-base across all depleted motifs. Motifs are considered depleted if the –log$_2$(target/no target) value is above 0.5. In the –log$_2$(target/no target) value, target and no target denote the frequency of a motif in the target and no target conditions, respectively. (B) Heatmaps showing four-base preferences for Csm6 with activator at the 60 minute timepoint as determined by the random motif library cleavage screen. Values represented in the heatmap are the counts of each four-base across all depleted motifs. Motifs are considered depleted if the –log$_2$(target/no target) value is above 0.5. In the –log$_2$(target/no target) value, target and no target denote the frequency of a motif in the target and no target conditions, respectively. (C) Heatmaps showing four-base preferences for Csm6 with activator and rNTPs at the 60 minute timepoint as determined by the random motif library cleavage screen. Values represented in the heatmap are the counts of each four-base across all depleted motifs. Motifs are considered depleted if the –log$_2$(target/no target) value is above 0.5. In the –log 2(target/no target) value, target and no target denote the frequency of a motif in the target and no target conditions, respectively.
Figure 15:
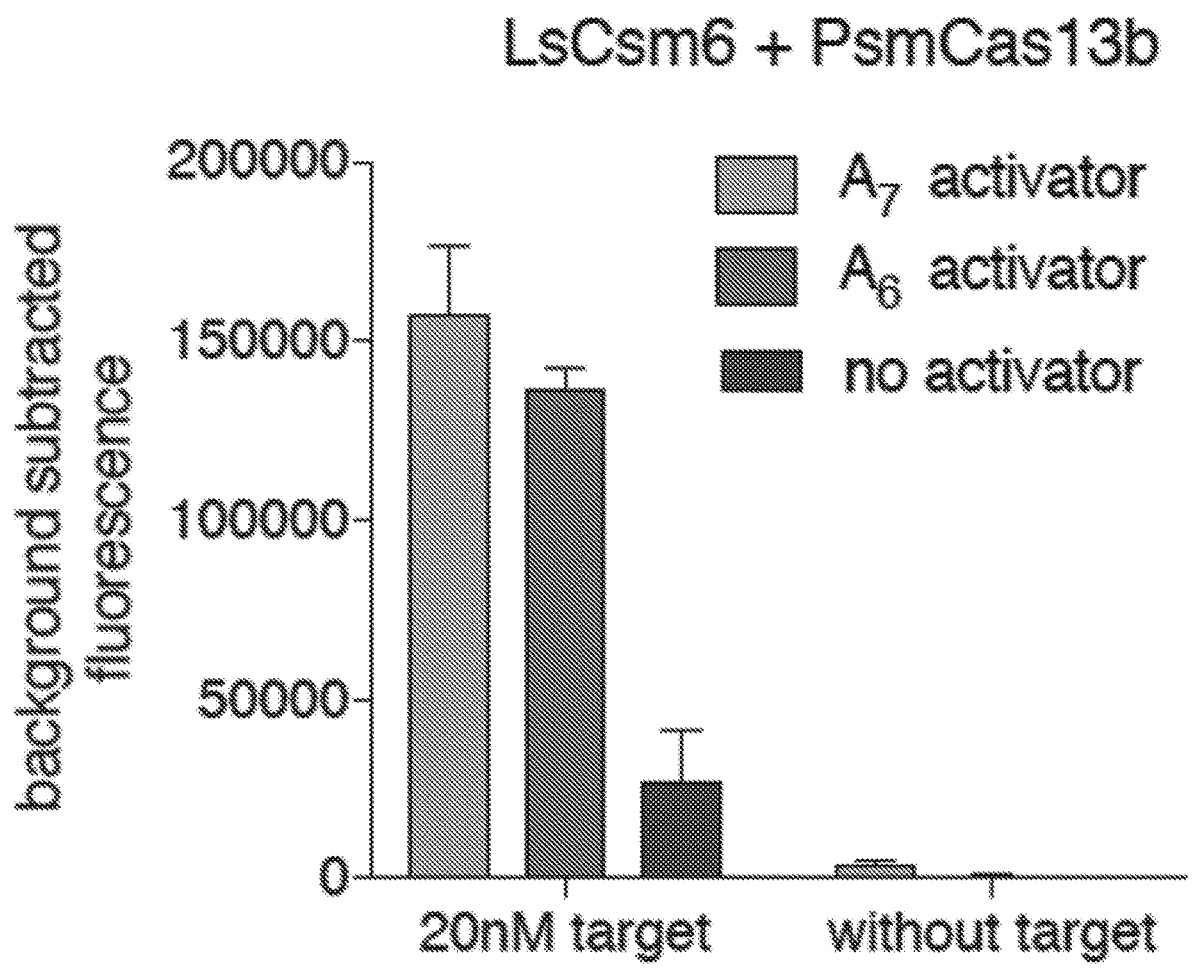
FIG. 15—Csm6-enhanced PsmCas13b and LwaCas13a detection for agricultural applications. EiCsm6 enhancement of PsmCas13b detection at various lengths of poly-A activators.

Intrigued by recent studies that demonstrated nucleic acid-based allosteric activation of the CRISPR type-III effector nuclease Csm6, Applicants wondered whether Cas13's endonucleolytic activity is able to generate potent Csm6 activators composed of linear RNA adenylates with 2,3 cyclic phosphate ends (FIG. 7C, 7D). Applicants therefore sought to characterize the RNA-end chemistry of Cas13 derived cleavage products by performing Cas13 in vitro cleavage assays on A or U homopolymer-loop containing synthetic ssRNA 2 (FIG. 7A). Post-cleavage fluorescent labeling of in vitro cleavage reaction demonstrated that LwaCas13a and PsmCas13b produce cleavage products with 5'hydroxylated and 2'3' cyclic phosphate RNA ends (FIG. 7B). This result led us to express and purify both known and novel Csm6 orthologs for exploring the use of Csm6 together with Cas13 for positive-feedback signal amplification (FIGS. 7C and 8). By testing RNA adenylate with different lengths and 3' end modifications, Applicants found that EiCsm6 and LsCsm6 are efficiently activated by hexadenylates containing a 2'3' cyclic phosphate end (FIGS. 7D and 10). Moreover, Applicants found that Csm6 orthologs have a strong cleavage preference for A and C homopolymeric RNA sensors (FIG. 7D). In order to get a more comprehensive insight into the cleavage specificity of Csm6, Applicants performed in vitro cleavage assay and RNA sequencing on the same 6-mer degenerated RNA reporter library used for Cas13. Surprisingly, depleted sequence motif analysis revealed a strong preference for guanosine (FIGS. 7F-7G and 12-14), a result Applicants did not anticipate due to the inefficient cutting of the homopolymeric G-RNA sensor. However, given the strong cleavage activity on homopolymeric A-RNA sensors, Applicants used this design for future Csm6 experiments which also allows us to independently measure LwaCas13a and EiCsm6 due to their distinct cleavage preference.

Example 3—Positive Feedback Signal Amplification with Crispr-CSM6

To couple the activity of Cas13 with Csm6 activation, Applicants designed RNA activators that would produce optimal Csm6 stimulation upon Cas13 cleavage. Applicants incubated PsmCas13b with longer poly-A activators that would be reduced in length from cleavage to generate short cyclic-phosphate terminated activators. PsmCas13b digestion of activators resulted in modest increases in LsCsm6 activity (FIG. 14A), possibly due to a range of sub-activators generated from cleavage.

Figure 16:
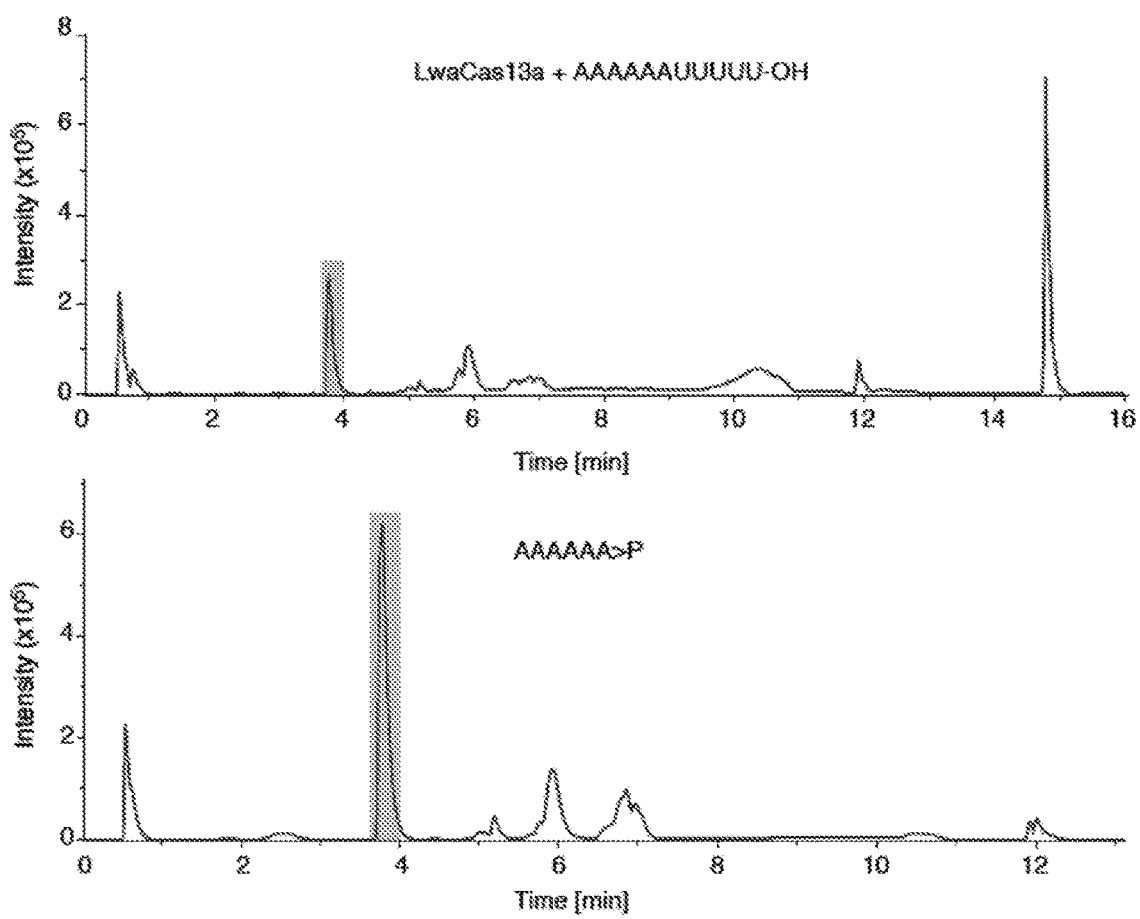
FIG. 16—Mass spectrometry analysis of cleavage ends from LwaCas13a. (A) Chromatographic traces showing elution profiles for LwaCas13a-digested activator (top) or 2,3 cyclic phosphate activator (bottom). Blue highlighted peaks were analyzed for mass spectrometry in FIG. 5. (B) Table of abundances for different compounds detected by mass spectrometry in LwaCas13a-digested activator (left) or 2,3 cyclic phosphate activator (right) samples (SEQ ID NO: 137).
Figure 17:
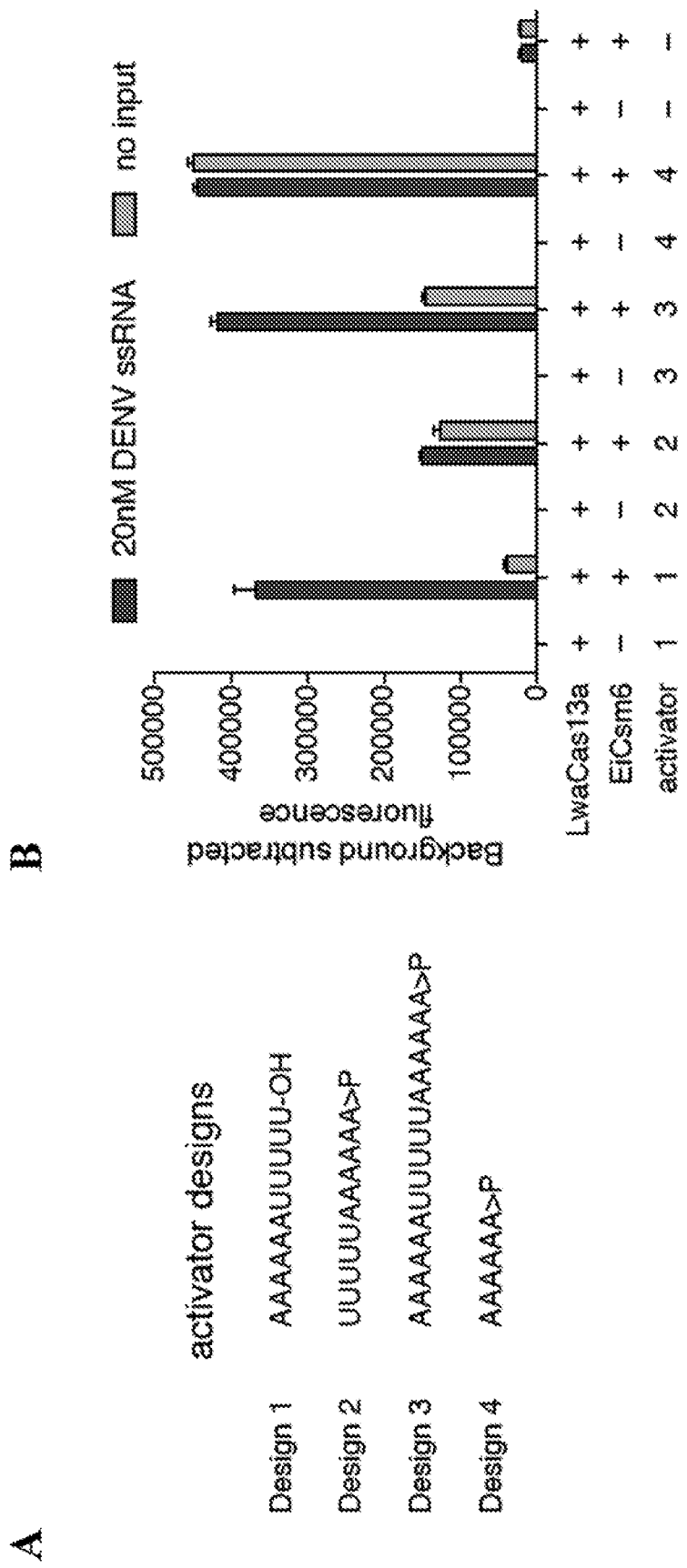
FIG. 17—Effect of reporter and activator optimizations on Csm6-enhancement of LwaCas13a activity. (A) Schematic of different activator designs for Csm6 enhancement of Cas13a activity (SEQ ID NOs: 137, 138 and 139). (B) Performance of EiCsm6 enhancement of LwaCas13a detection for different activator designs.
Figure 18:
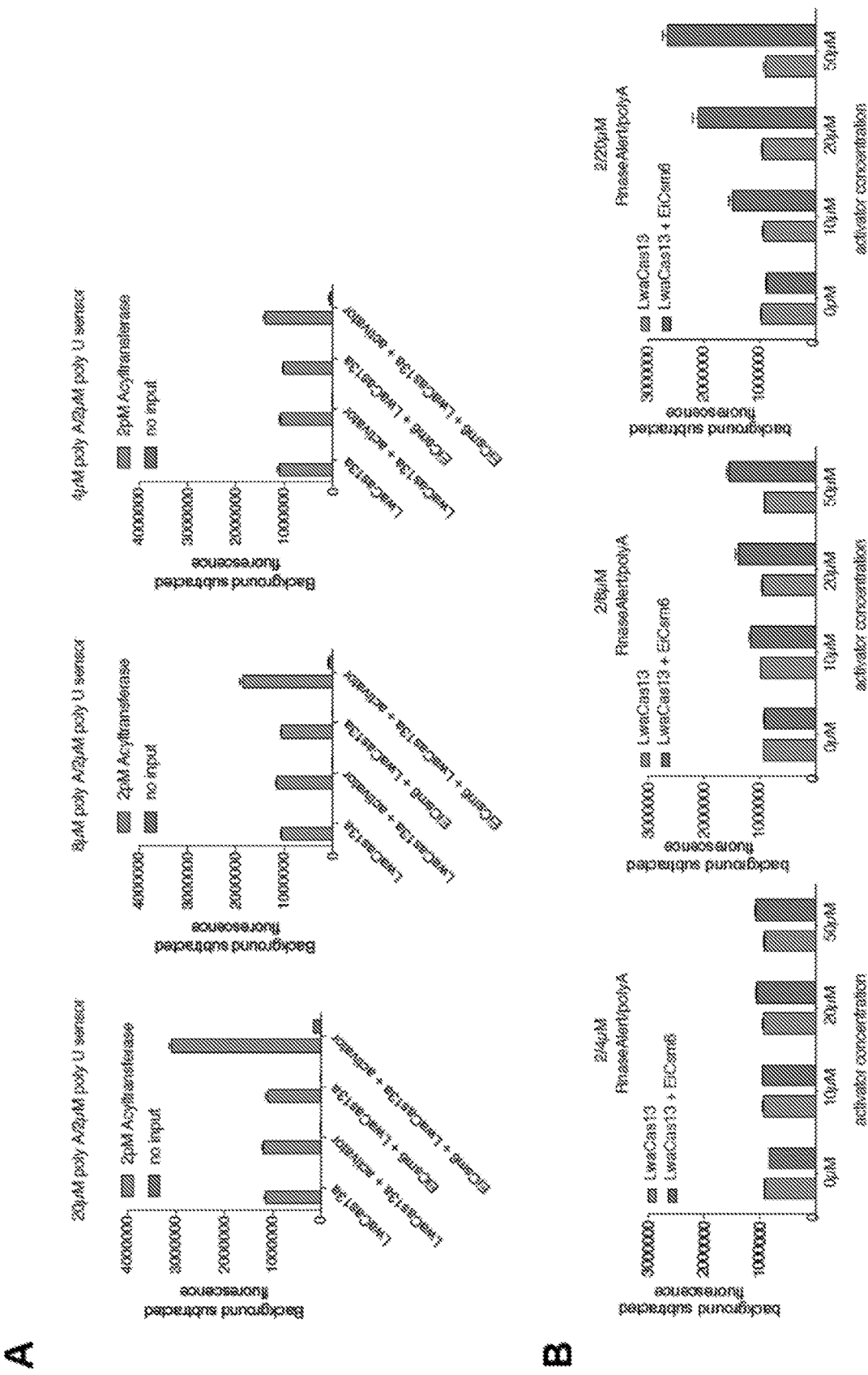
FIG. 18—Effect of reporter and activator concentrations on Csm6-enhancement of LwaCas13a activity. (A) EiCsm6 enhancement of LwaCas13a detection at various ratios of poly A and poly U reporters. (B) EiCsm6 enhancement of LwaCas13a detection at various concentrations of (A)$_6$-(U)$_5$ activator.
Figure 19:
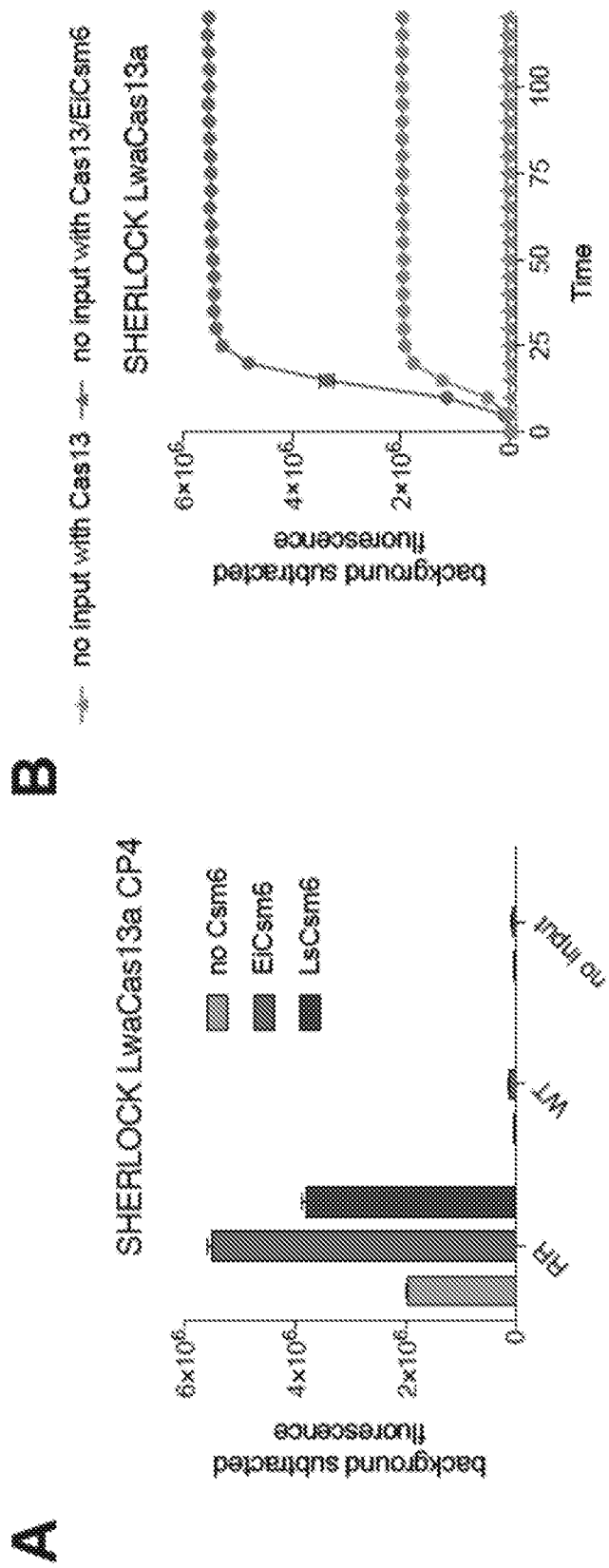
Figure 20:
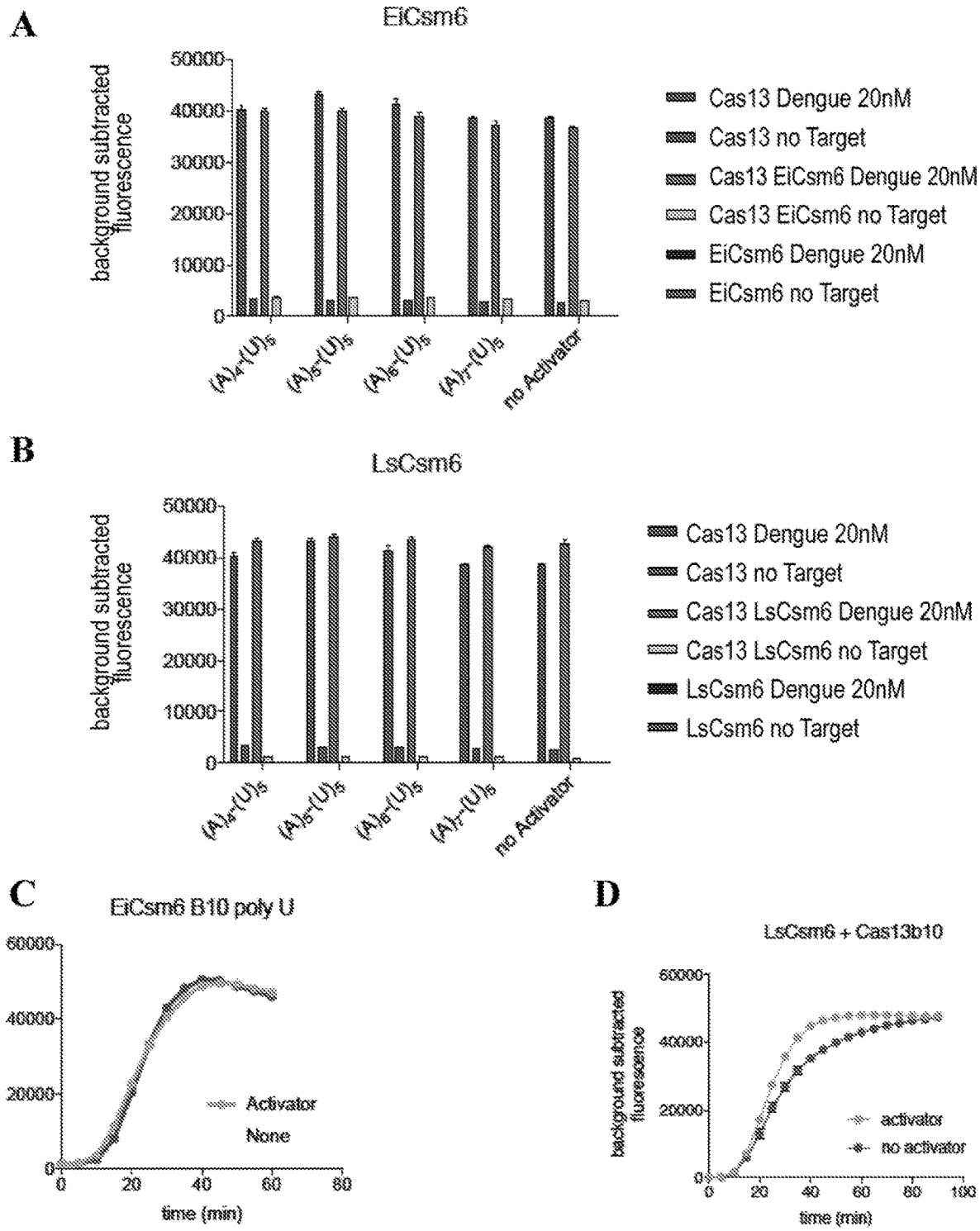
FIG. 20—(A)-(D) Csm6 enhances the signal from the U-cleaving CcaCas13b enzymes.

Applicants improved upon this approach by designing RNA activators that contained two base identities: a poly-A stretch of optimal activator length, followed by a poly-U stretch that could be cleaved by a U-targeting Cas13 enzyme. Applicants found that, upon addition of target, LwaCas13a was able to digest these activators and generate the optimal activators for EiCsm6 and LsCsm6, and that this activation required the correct length of poly-A (FIG. 7H). Using mass spectrometry, Applicants verified that LwaCas13a was producing the expected cyclic-phosphate terminated products for Csm6 activation (FIGS. 7I and 16A, B). Activation was most effective for designs with 3' protection with poly U, as other activation designs, including 5' protection with poly-U and internal poly-U tracts, were less effective at activating Csm6 only in the presence of target RNA (FIGS. 17A, B). By combining reporters for both Csm6 and Cas13 in the same reaction, Applicants were able to assay the combined cleavage activities of the two enzymes. Applicants found that increasing the activator concentration increased the synergistic benefit of Csm6 activated by Cas13 (FIG. 7J), and that increasing the Csm6-specific polyA reporter also increased the Csm6 signal, leading to a larger increase upon activator addition (FIG. 18A, B). Csm6-enhanced LwaCas13a increased the overall signal and kinetics of synthetic acetyltransferase genes as well as herbicide resistance from soybean genomic DNA (FIGS. 7K, L and 19A, B). Csm6 could also enhance the signal from the U-cleaving CcaCas13b enzymes (FIG. 20A-D).

Figure 21:
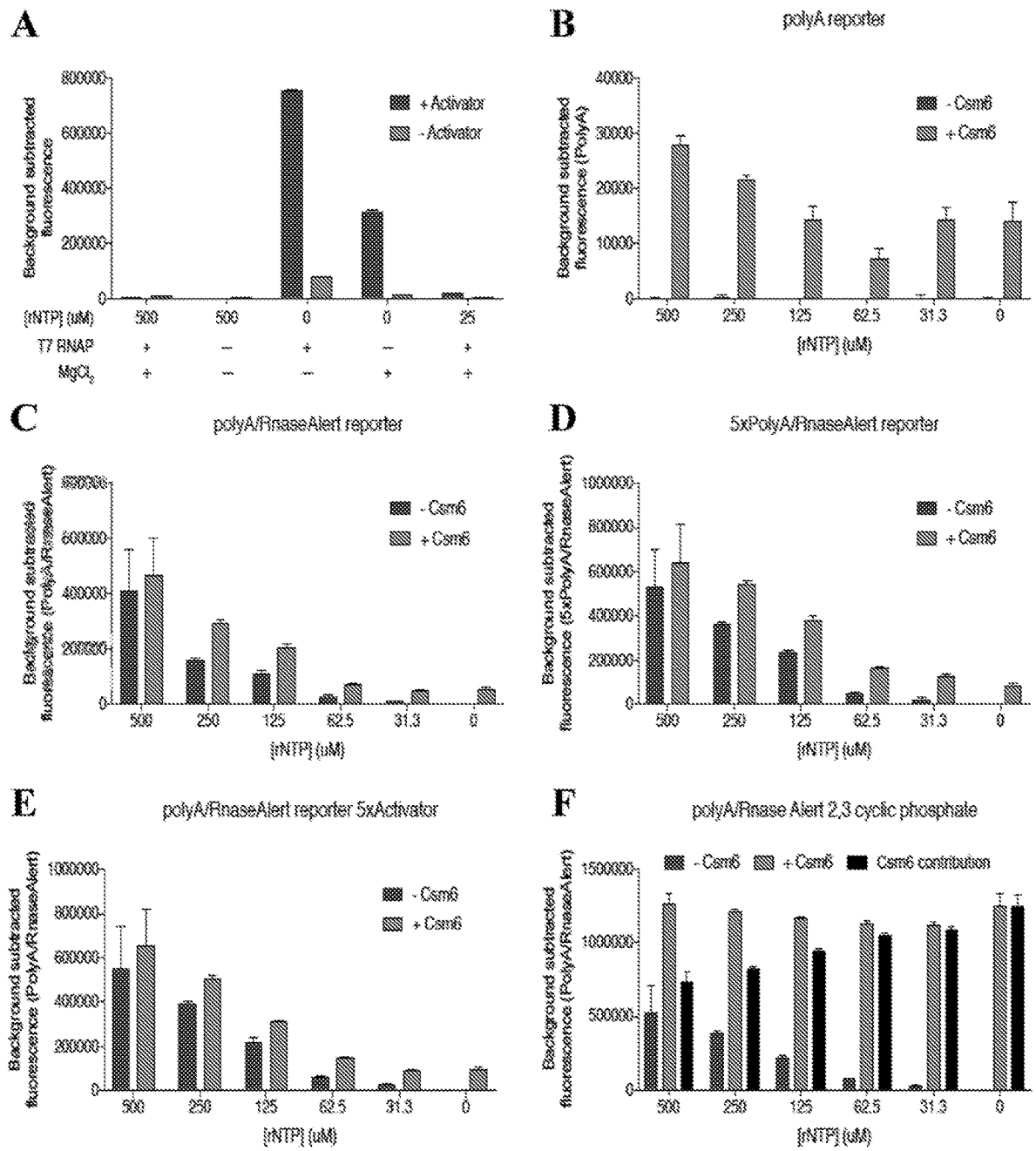
FIG. 21—Effect of in vitro transcription components on Csm6 activity. (A) EiCsm6 activity in the presence of IVT components, with and without 2,3 cyclic phosphate activator. Components include 3 mM additional MgCl2, 1 mM rNTP mix, 30 U T7 polymerase. (B) EiCsm6 and LwaCas13a activity with (A)$_6$-(U)$_5$ activator and poly-A reporter in the presence of various concentrations of ribonucleotides. (C) Combined EiCsm6 and LwaCas13a activity with (A)$_6$-(U)$_5$ activator and poly-A/RNaseAlert reporter combination in the presence of various concentrations of ribonucleotides. (D) Combined EiCsm6 and LwaCas13a activity with (A)$_6$-(U)$_5$ activator and poly-A/5× RNaseAlert reporter combination in the presence of various concentrations of ribonucleotides. (E) Combined EiCsm6 and LwaCas13a activity with 5×(A)$_6$-(U)$_5$ activator and poly-A/RNaseAlert reporter combination in the presence of various concentrations of ribonucleotides. (F) Combined EiCsm6 and LwaCas13a activity with cyclic phosphate activator and poly-A/RNaseAlert reporter combination in the presence of various concentrations of ribonucleotides.
Figure 22:
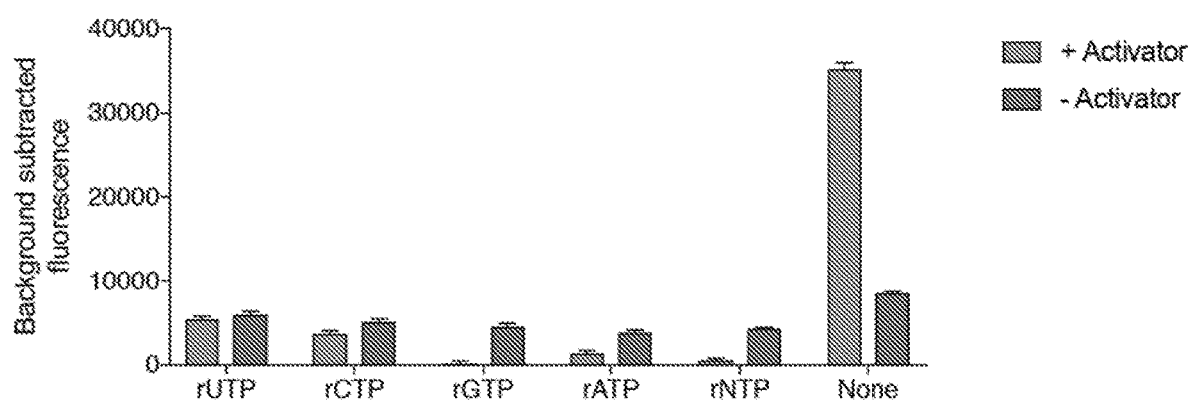
FIG. 22—Inhibition of Csm6 activity by various rNTPs. RNase activity of EiCsm6 with 2,3 cyclic phosphate in the presence of 1 mM various ribonucleotides, or in the absence of a rNTP mix at 1 mM each.
Figure 23:
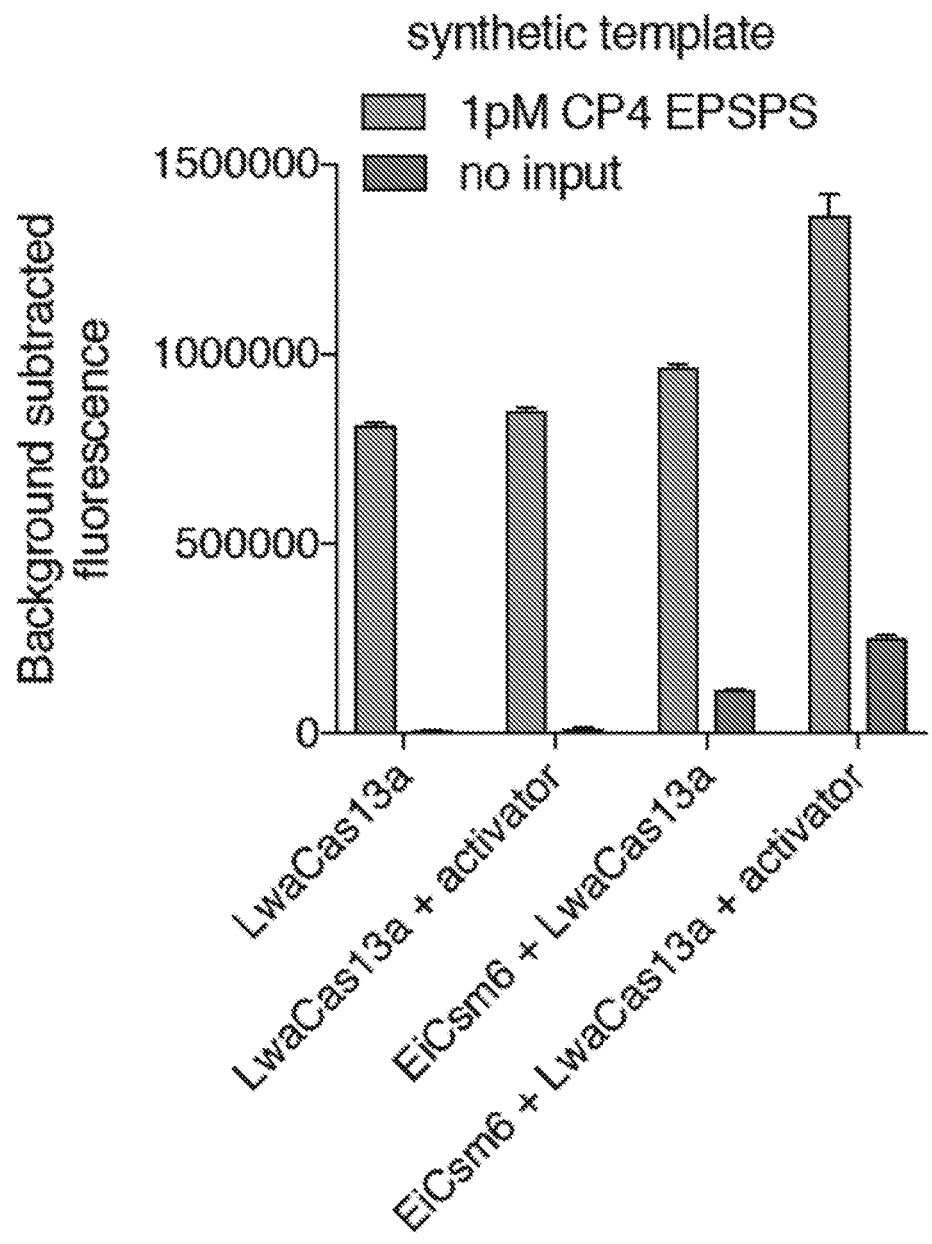
FIG. 23—Three-step SHERLOCK detection of herbicide resistance genes. RNase activity of EiCsm6 with 2,3 cyclic phosphate in the presence of 1 mM various ribonucleotides, or in the absence of a rNTP mix at 1 mM each.

As combining Csm6-enhancement with RPA pre-amplification would increase signal, Applicants tested Csm6 for activity in the presence of in vitro transcription components necessary for combination with RPA. Applicants found that both magnesium and free rNTP reduced the nuclease activity of Csm6 in the presence of a cyclic phosphate activator (FIG. 21A). Reducing the amount of rNTP in solution reduced the amount of transcribed RNA, and therefore had a negative effect on Csm6 activity from Cas13a (FIG. 21B-E), even in the presence of increased reporter or activator. Corresponding with these two competing factors, cyclic phosphate activator conditions, reducing rNTP restored Csm6-specific signal (FIG. 21F). All rNTP species tested resulted in Csm6 inhibition, indicating that Csm6 and rNTP solutions would need to be performed in different reactions (FIG. 22). Applicants therefore separated the transcription step into a separate reaction, allowing for sufficient amplification while diluting the resulting rNTP in the Csm6 reaction, and this separated reaction was able to robustly detect herbicide resistance genes (FIG. 23).

Figure 24:
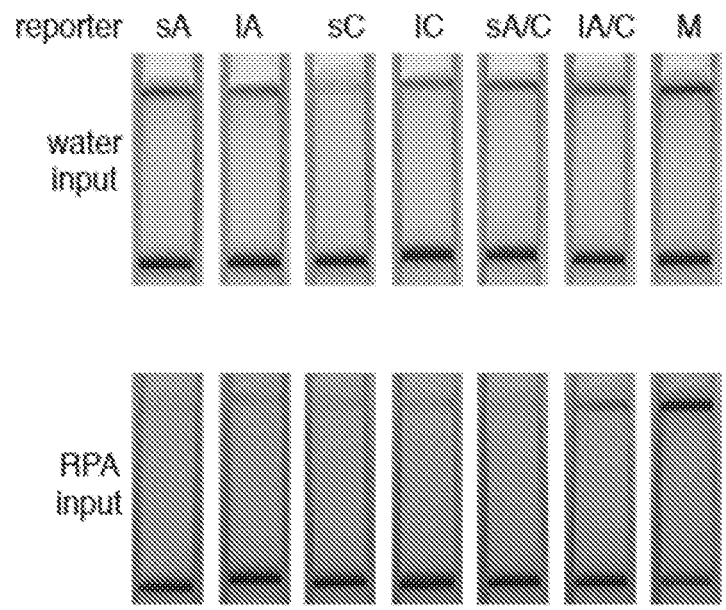
FIG. 24—Lateral flow Csm6-enhanced SHERLOCK with different reporter combination. (A) Lateral-flow detection of Csm6-enhanced SHERLOCK with various reporter designs. sA: short poly-A sensor; 1A: long poly A sensor; sC: short poly C sensor; 1C: long poly C sensor; sA/C: short poly-A/C sensor; 1A/C: long poly-A/C sensor; M: mixed RNase alert-like sensor. (B) Quantitation of band intensity from detection in (A).
Figure 24:
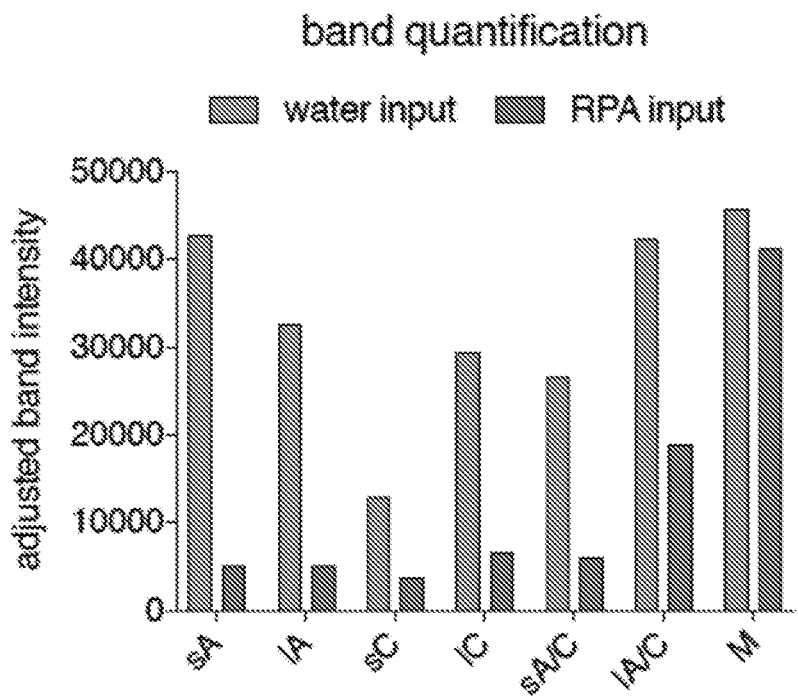

Applicants hypothesized that combining Csm6 with Cas13 detection on lateral flow could reduce background of the visual readout by employing a combination of reporters, preventing cleavage of a single reporter sequence and false positive readout. Applicants tested lateral flow reporters of various sequence and length in the presence of Csm6 and activator, and found that a long A/C reporter could have signal but maintain orthogonality from LwaCas13 (FIG. 24A, B). Applicants used this reporter in combination with the RNaseAlert reporter to detect dengue sample in the absence of RPA amplification, and only in the presence of Csm6 (FIG. 7M). Applicants subsequently combined RPA, Csm6, and lateral flow to detect an acyltransferase target, and found that Csm6 was necessary for detection when a mixed probe was used, and that background was reduced. (FIG. 7N). Overall, this combination of technologies leads to a fast and robust visual detection.

Figure 28:
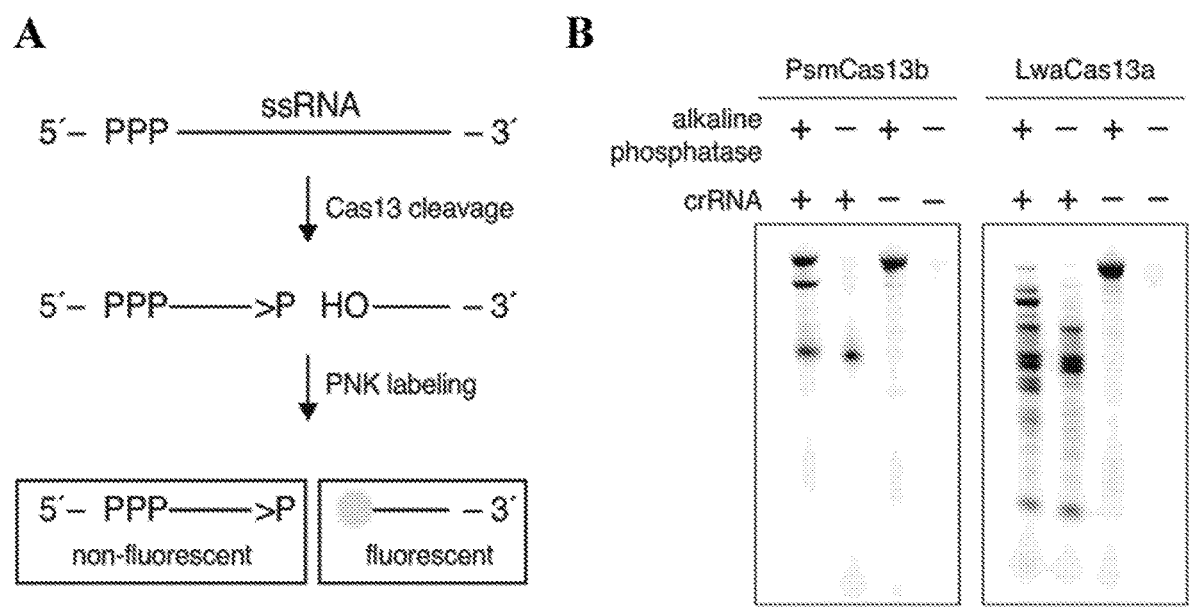
FIG. 28—Profiling of cleavage ends generated by LwaCas13a and PsmCas13b. (A) Schematic for detection of 2,3 cyclic phosphate ends via PNK labeling and gel electrophoresis. (B) Electrophoresis gel demonstrating 2,3 cyclic phosphate ends generated by LwaCas13a or PsmCas13b cleavage of ssRNA target 2 or 3 (homopolymer loops). The Cas13 enzyme is incubated with the appropriate crRNA targeting the ssRNA target and the cleavage products are 5' labeled with a dye IR800 with or without alkaline phosphatase treatment.
Figure 29:
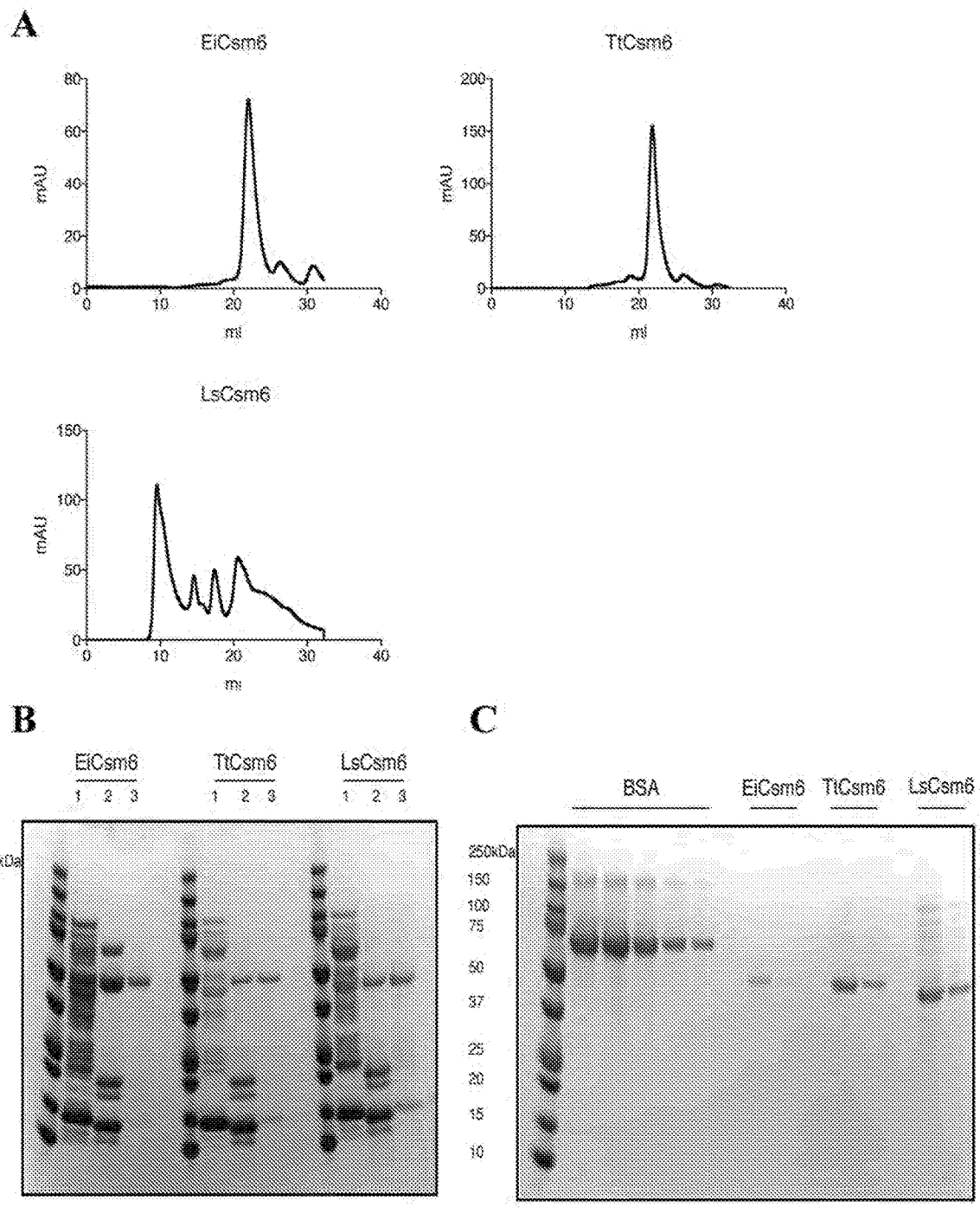
FIG. 29—Protein purification of Csm6 orthologs. (A) Chromatograms of size exclusion chromatography for EiCsm6, TtCsm6, LsCsm6 and SaCsm6 used in this study. Measured UV absorbance (mAU) is shown against the elution volume (ml). (B) SDS-PAGE gel of EiCsm6, TtCsm6 and LsCsm6 fractions prior to size exclusion chromatography. Fractions show the bacterial lysate supernatant (1) after streptactin incubation, streptactin resins after cleavage with SUMO protease (2), as well as released, untagged Csm6 protein (3). (C) Final SDS-PAGE of concentrated Csm6 proteins after size exclusion chromatography. BSA standard curve (left) is used to quantify Csm6 proteins (right). Five dilutions of BSA and two dilutions of EiCsm6, TtCsm6 and LsCsm6 are shown.
Figure 30:
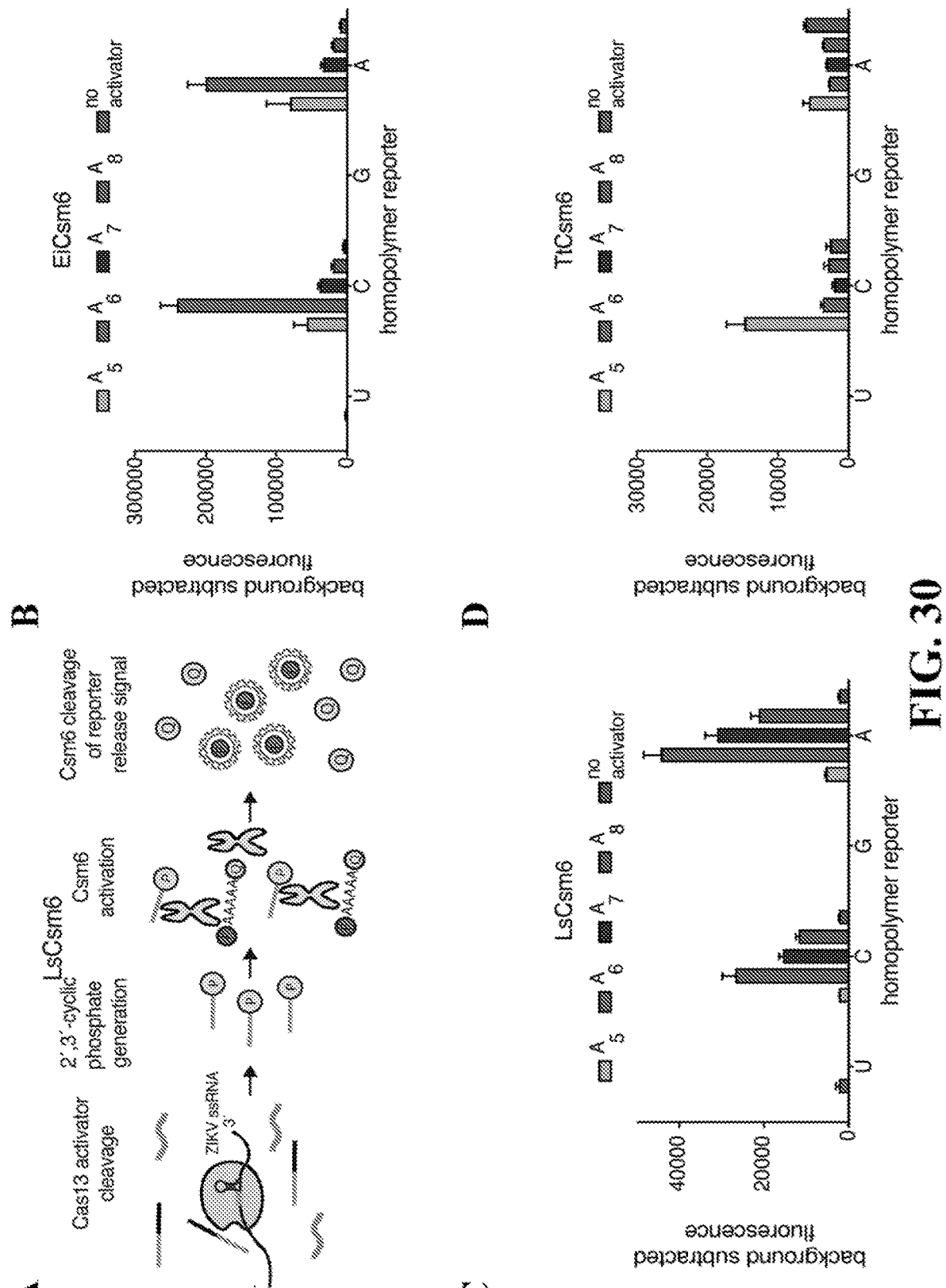
FIG. 30—Base preference and activation of Csm6 orthologs. (A) Schematic for Csm6-mediated positive feedback in a SHERLOCK reaction. (B) Activation of EiCsm6 by 2', 3'-cyclic phosphate-terminated adenine oligomers of different lengths. Csm6 cleavage is measured using an RNA reporter consisting of A, C, G, or U homopolymer with ends labeled with a fluorophore and quencher. (C) Base preference of LsCsm6 cleavage activated by 2', 3'-cyclic phosphate-terminated adenine oligomers. (D) Base preference of TtCsm6 cleavage activated by 2', 3'-cyclic phosphate-terminated adenine oligomers.
Figure 31:
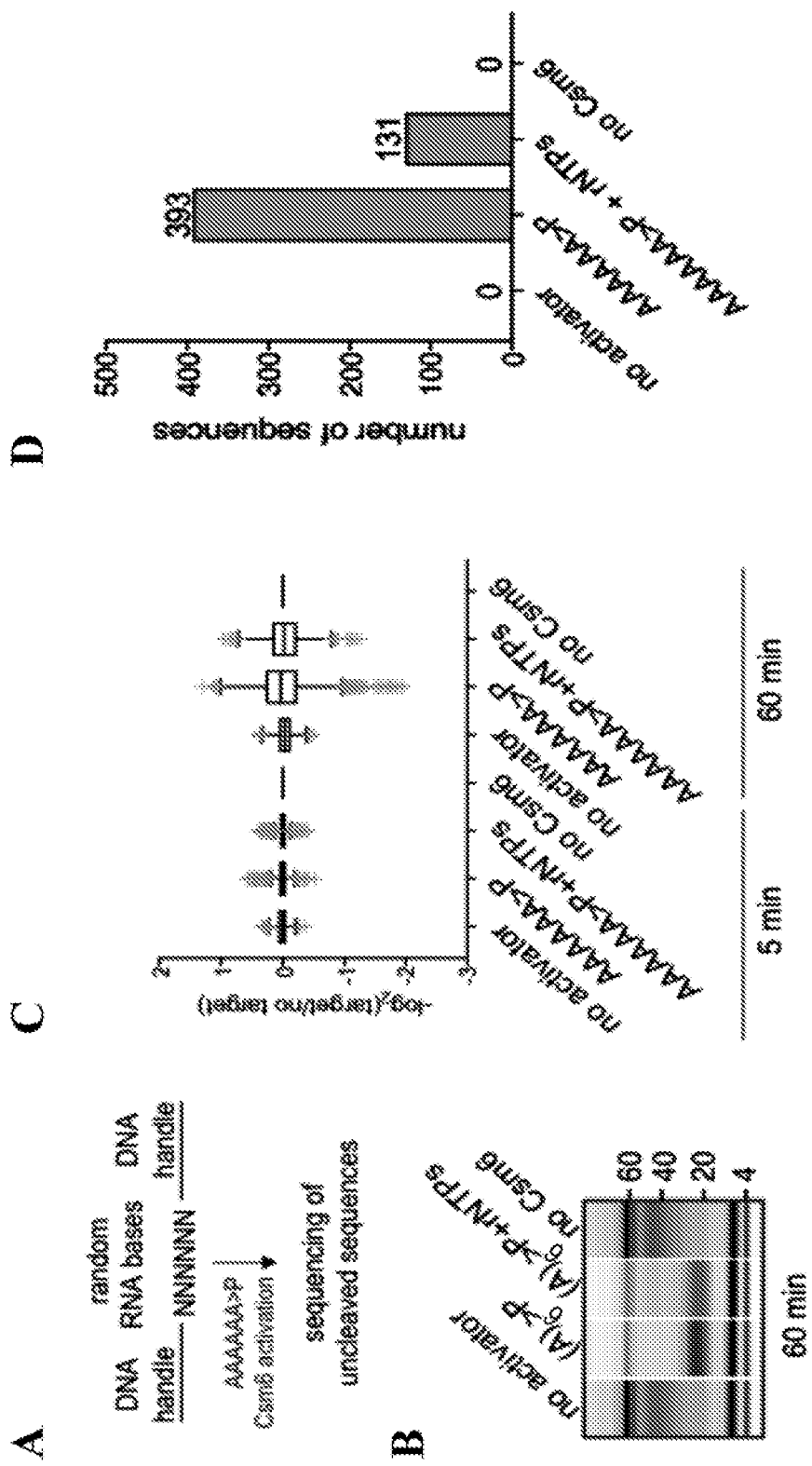
FIG. 31—Size analysis and representation of various motifs after Csm6 cleavage. (A) Schematic of cleavage motif preference discovery screen for Csm6 orthologs. (B) Bioanalyzer traces for EiCsm6 samples showing changes in library size after RNase activity that is activator dependent. (C) Box plots showing motif distribution of target to non-target motif ratios for Csm6, Csm6 with activator, Csm6 with activator and rNTPs, or background library at 5 minute and 60 minute timepoints. (D) Number of depleted motifs for Csm6, Csm6 with activator, Csm6 with activator and rNTPs, or background library at the 60 minute timepoint.
Figure 32:
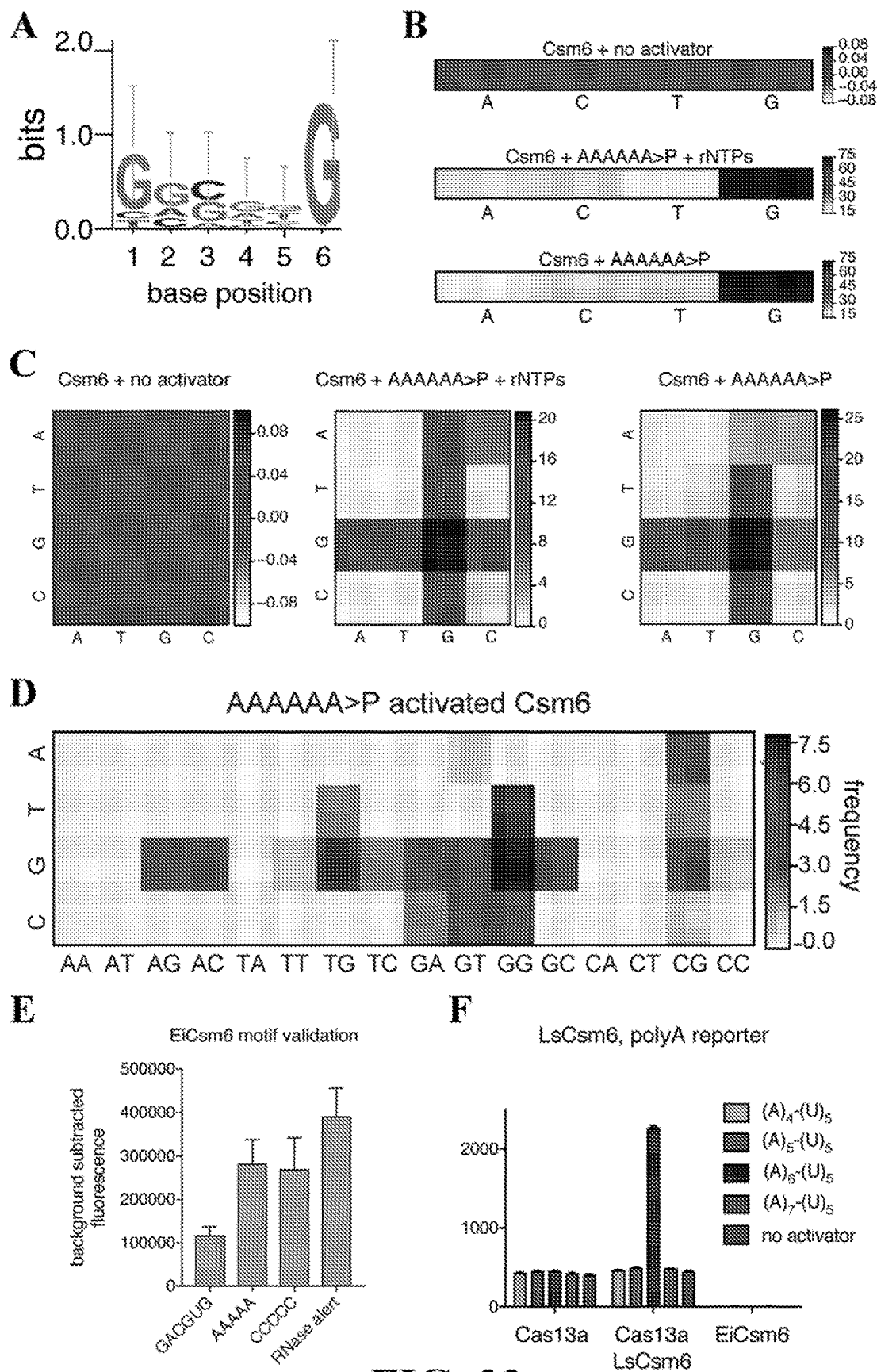
FIG. 32—Single- and two-base preferences for Csm6 conditions determined by random motif library screen. (A) Sequence logo of preferred sequence motif for EiCsm6 cleavage activity. (B) Heatmaps showing single base preferences for Csm6, Csm6 with activator, and Csm6 with activator and rNTPs at the 60 minute timepoint as determined by the random motif library cleavage screen. Values represented in the heatmap are the counts of each single-base across all depleted motifs. Motifs are considered depleted if the −log 2(target/no target) value is above 0.5. In the −log 2(target/no target) value, target and no target denote the frequency of a motif in the target and no target conditions, respectively. (C) Heatmaps showing two-base preferences for Csm6, Csm6 with activator, and Csm6 with activator and rNTPs at the 60 minute timepoint as determined by the random motif library cleavage screen. Values represented in the heatmap are the counts of each two-base across all depleted motifs. Motifs are considered depleted if the −log 2(target/no target) value is above 0.5. In the −log 2(target/no target) value, target and no target denote the frequency of a motif in the target and no target conditions, respectively. (D) Heatmap of preferred 3-base motifs for EiCsm6 cleavage activity. Values represented in the heatmap are the counts of each 3-base across all depleted motifs. Motifs are considered depleted if the −log 2(target/no target) value is above 0.5. In the −log 2(target/no target) value, target and no target denote the frequency of a motif in the target and no target conditions, respectively. (E) Cleavage activity of EiCsm6 on top reporter sequences derived from the random motif library screen. (F) Activation of LsCsm6 by LwaCas13a cleavage of adenine-uridine activators with different length adenine tracts. LwaCas13a is targeting synthetic DENV ssRNA.
Figure 33:
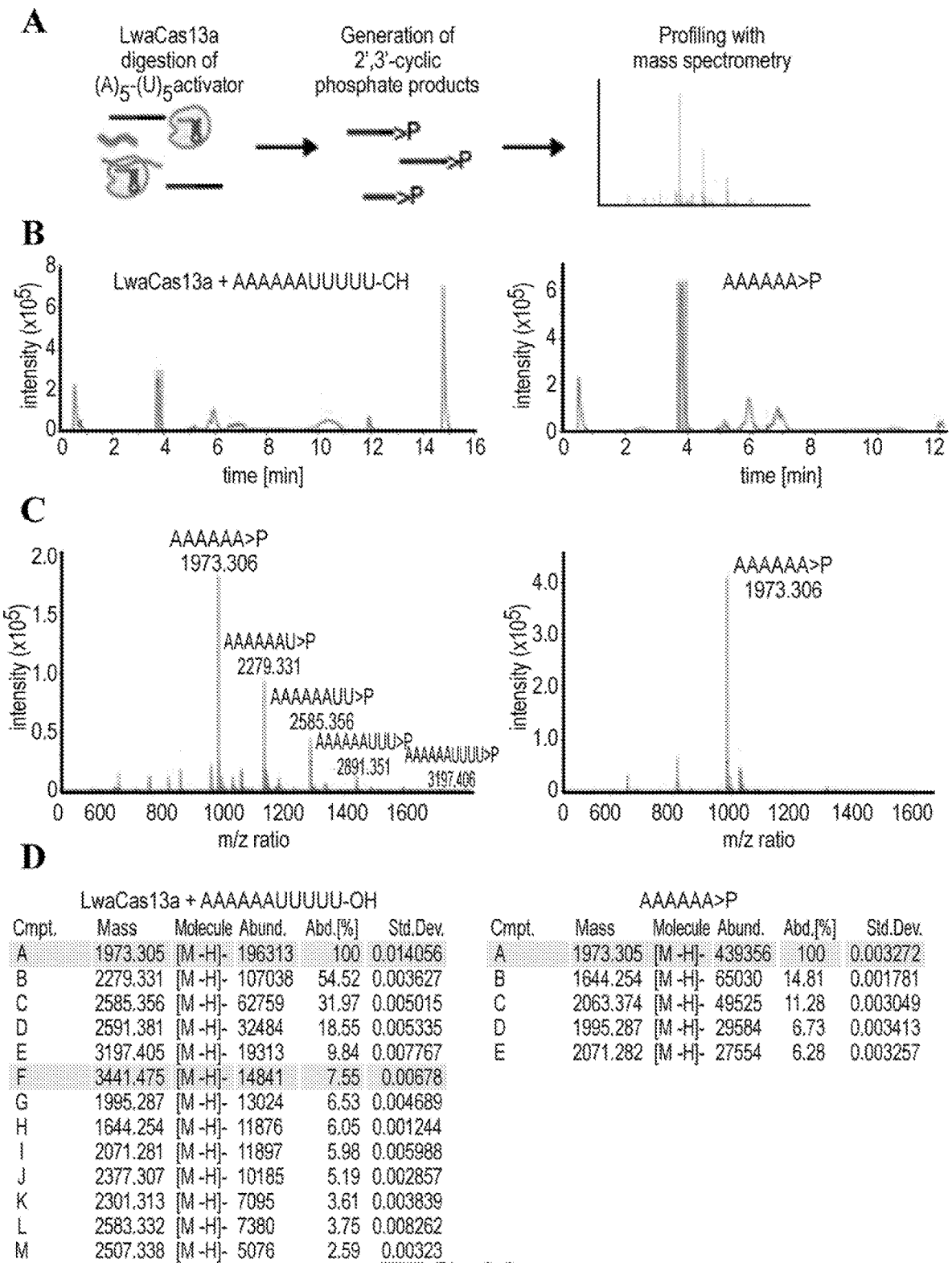
FIG. 33—Mass spectrometry analysis of cleavage ends from LwaCas13a. (A) Schematic of LwaCas13a digestion and mass spectrometric analysis to verify cleavage products. (B) Mass spectrometry analysis of digestion products from LwaCas13a collateral cleavage (left) or 2,3 cyclic phosphate activator alone (right). Dominant peaks are labeled with mass and corresponding structure. (C) Chromatographic traces showing elution profiles for LwaCas13a-digested activator (top) or 2,3 cyclic phosphate activator (bottom). (D) Table of abundances for different compounds detected by mass spectrometry in LwaCas13a-digested activator (left) or 2,3 cyclic phosphate activator (right) samples.
Figure 34:
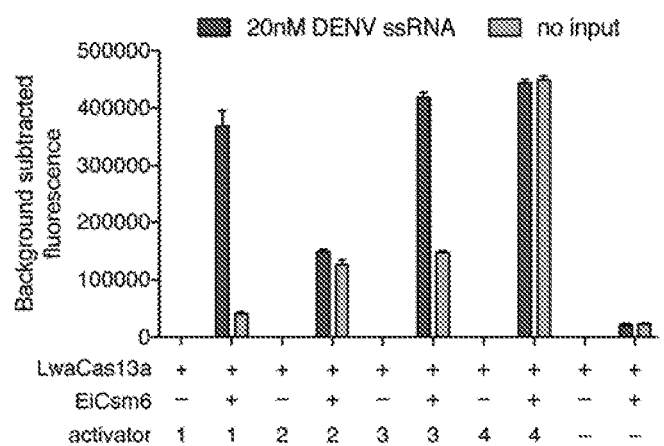
FIG. 34—Effect of reporter and activator optimizations on Csm6-enhancement of LwaCas13a activity. (A) Schematic of different activator designs for Csm6 enhancement of Cas13a activity. (B) Performance of EiCsm6 enhancement of LwaCas13a detection for different activator designs.

Example 4—Csm6-Enhanced LwaCas13a to Increase Synthetic Acyltransferase Gene Detection Signal In order to amplify the detection signal, Applicants leveraged the CRISPR type-III effector nuclease Csm6, which is activated by cyclic adenylate molecules or linear adenine homopolymers terminated with a 2', 3'-cyclic phosphate. LwaCas13a and PsmCas13b collateral activity generates cleavage products with hydroxylated 5' ends and 2', 3'-cyclic phosphate ends (FIG. 28), suggesting that Cas13 collateral activity could generate Csm6 activating species, which would allow for amplified signal detection in the SHERLOCK assay. By testing RNA adenylate molecules of different lengths and 3' end modifications (FIG. 29 and FIG. 30A; FIG. 38), Applicants found that Csm6 from *Enterococcus italicus* (EiCsm6) and Csm6 from *Lactobacillus salivarius* (LsCsm6) were efficiently activated by hexadenylates containing 2', 3'-cyclic phosphate ends (FIG. 30B-C). Moreover, EiCsm6, LsCsm6, and Csm6 from *Thermus thermophilus* (TtCsm6) demonstrated a strong cleavage preference for A- and C-rich sensors based on sensor screening, enabling independent measurements of LwaCas13a and Csm6 cleavage activity in separate channels (FIG. 25D and FIG. 30B-D, FIG. 3, FIG. 32A-E).

Figure 25:
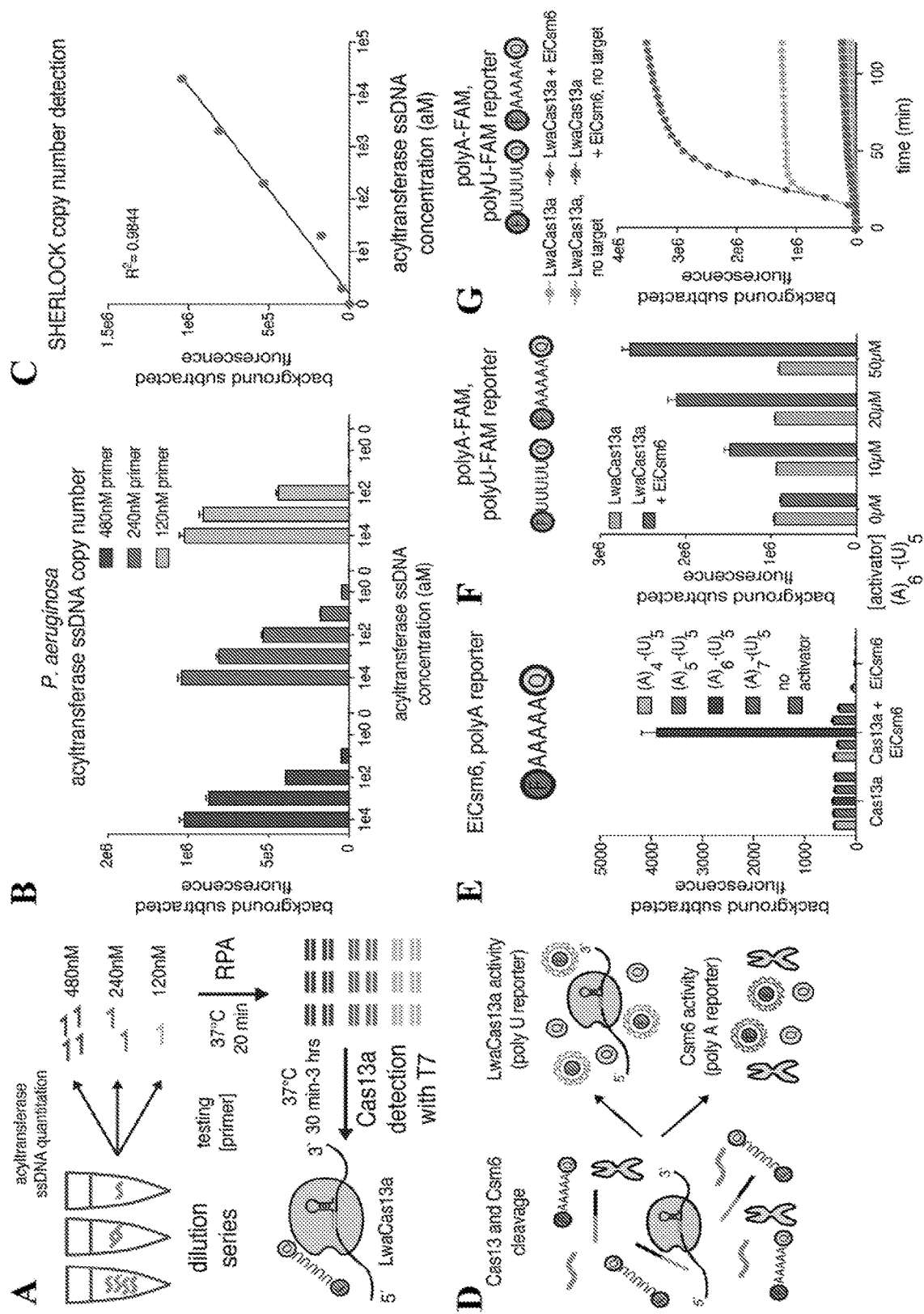
FIG. 25—Single molecule quantitation and enhanced signal with SHERLOCK and Csm6. (A) Schematic of DNA reaction scheme for quantitation of P. aeruginosa synthetic DNA. (B) Quantitation of P. aeruginosa synthetic DNA at various RPA primer concentrations. Values represent mean+/−S.E.M. (C) Correlation of P. aeruginosa synthetic DNA concentration with detected fluorescence. Values represent mean+/−S.E.M. (D) Schematic of independent readout of LwaCas13a and Csm6 cleavage activity with orthogonal reporters. (E) Activation of EiCsm6 by LwaCas13a cleavage of adenine-uridine 332 activators with different length adenine tracts. LwaCas13a is targeting synthetic DENV ssRNA. Values represent mean+/−S.E.M. (F) Combined LwaCas13a and EiCsm6 signal for increasing concentrations of (A)$_6$-(U)$_5$ activator detecting 20 nM of DENV ssRNA. Values represent mean+/−S.E.M. (G) Kinetics of EiCsm6-enhanced LwaCas13a SHERLOCK detection of P. aerunoginosa acyltransferase synthetic target.
Figure 27:
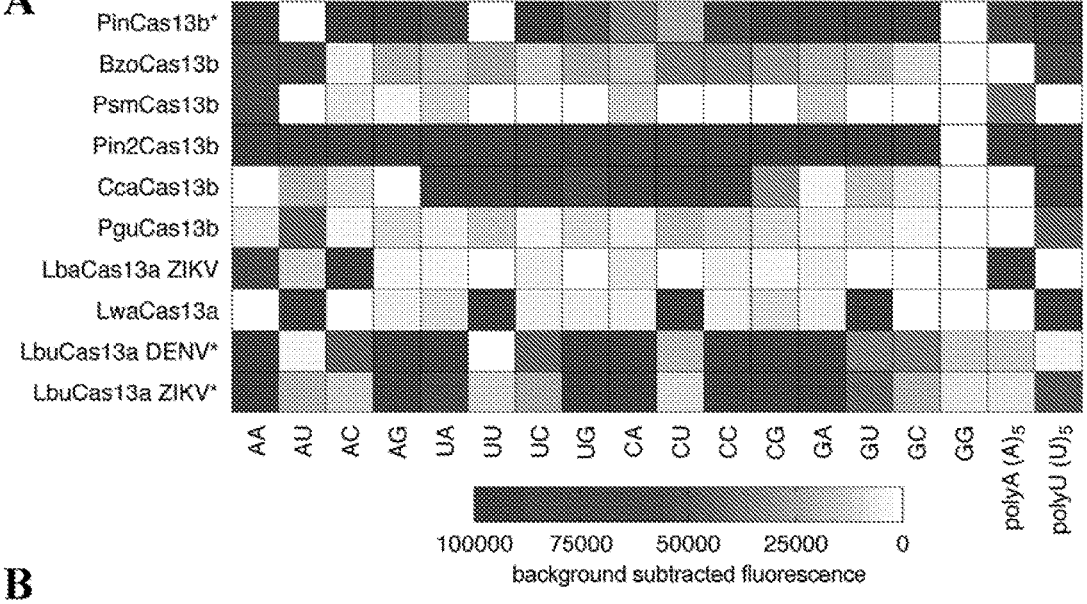
FIG. 27—Di-nucleotide preferences of Cas13a/b enzymes. (A) Heatmap of the di-nucleotide base preference of 10 Cas13a/b orthologs targeting ssRNA 1, unless otherwise indicated, with reporters consisting of a di-nucleotide of A, C, G, or U RNA bases (*) represent non-background subtracted orthologs with high background activity. (B) Heatmap of the di-nucleotide base preference of the high background activity orthologs LbuCas13a and PinCas13b tested on indicated targets. (C) Cleavage activity of LbuCas13a on AU di-nucleotide motif with and without 20 nM DENV ssRNA target tested with varying spacer lengths. (D) Cleavage activity of LbuCas13a on UG di-nucleotide motif with and without 20 nM DENV ssRNA target tested with varying spacer lengths.
Figure 27:
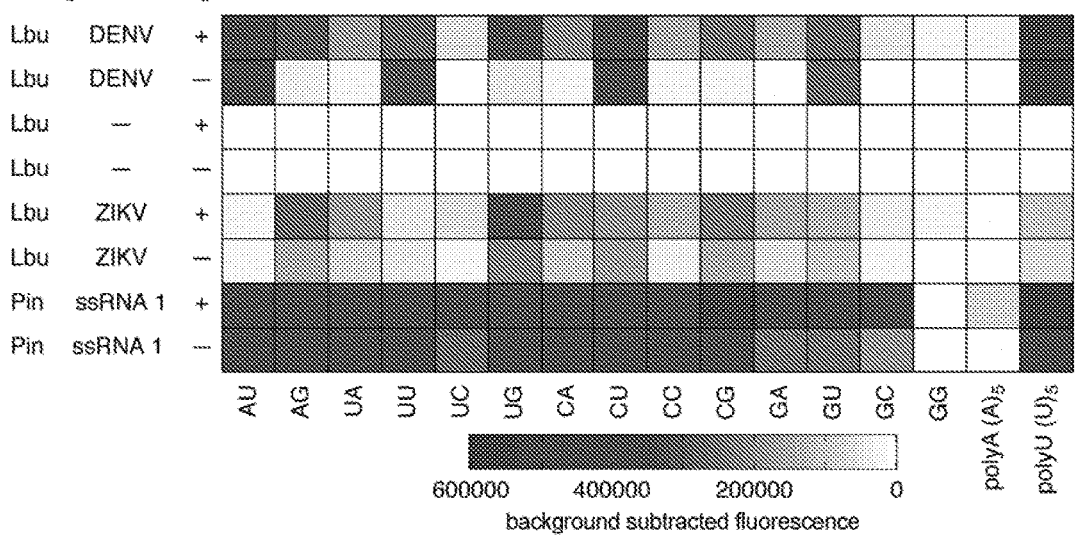
Figure 27:
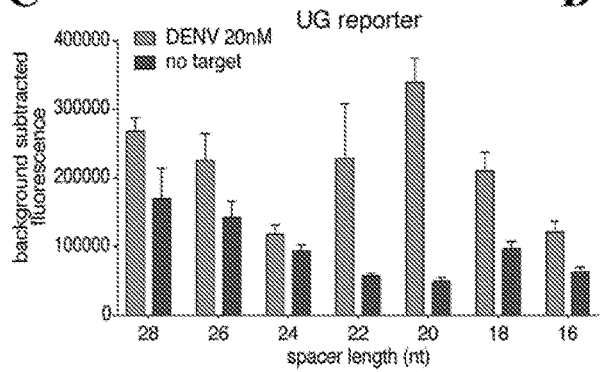
Figure 27:
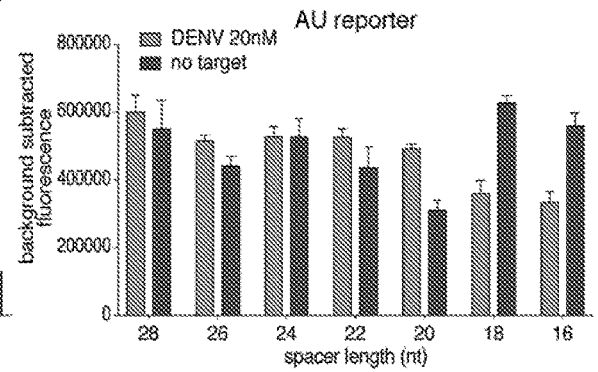
Figure 35:
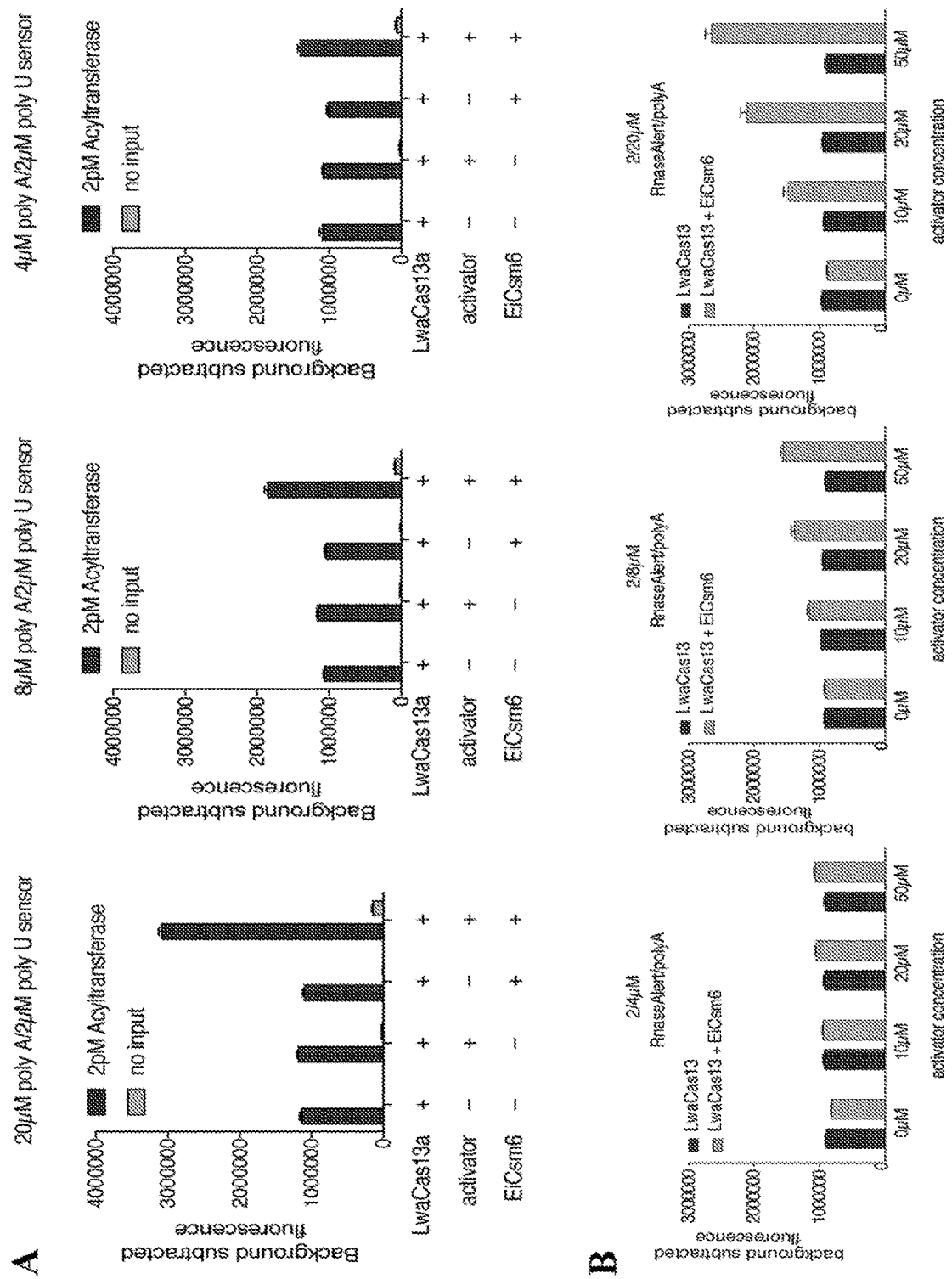
FIG. 35—Effect of reporter and activator concentrations on Csm6-enhancement of LwaCas13a activity. (A) EiCsm6 enhancement of LwaCas13a detection at various ratios of poly A and poly U reporters. (B) EiCsm6 enhancement of LwaCas13a detection at various concentrations of (A)6-(U)5 activator.
Figure 36:
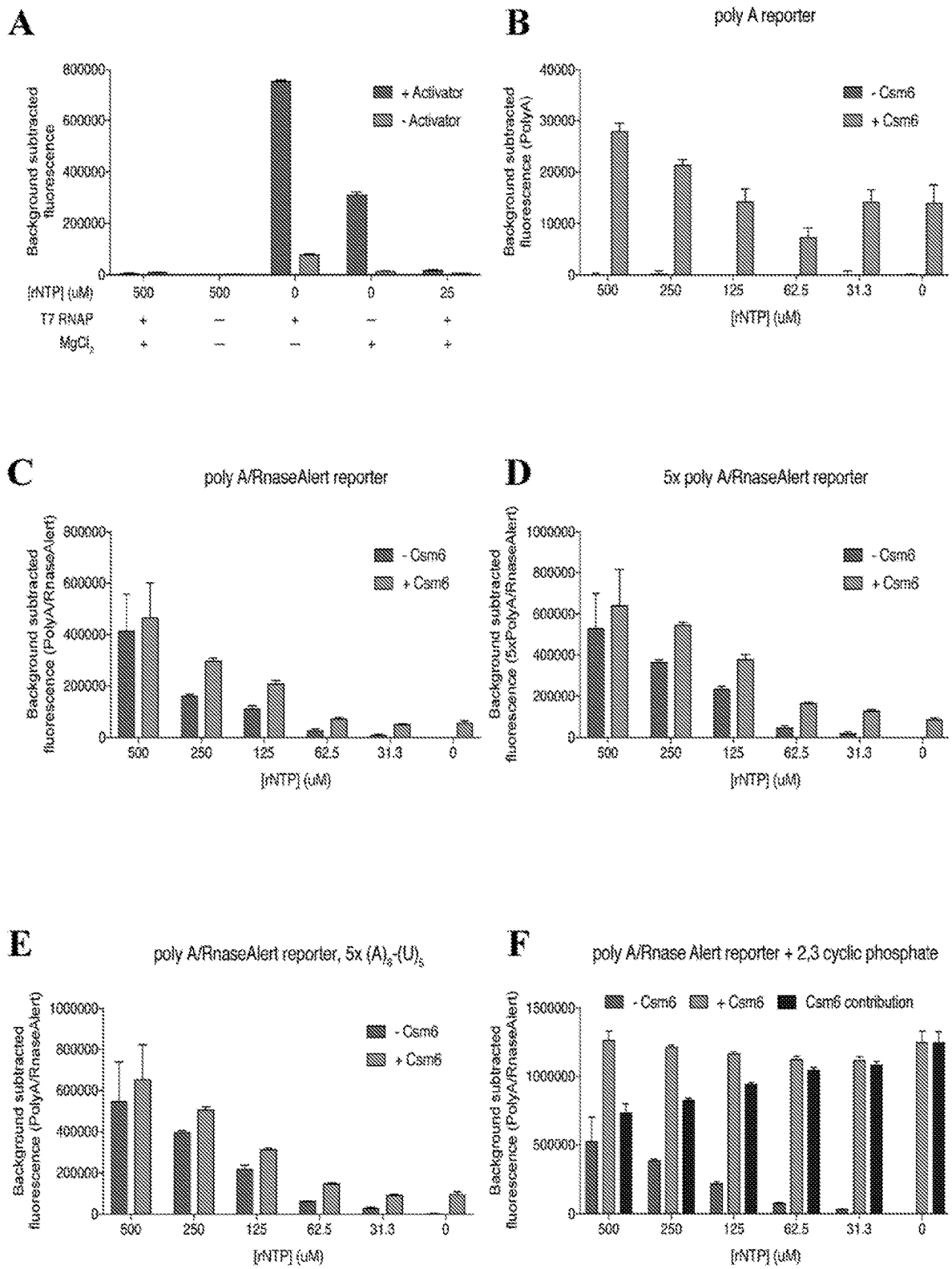
FIG. 36—Effect of in vitro transcription components on Csm6 activity. (A) EiCsm6 activity in the presence of IVT components, with and without 2,3 cyclic phosphate activator. Components include 3 mM additional MgCl2, 1 mM rNTP mix, 30U T7 polymerase. (B) EiCsm6 and LwaCas13a activity with (A)6-(U)5 activator and poly-A reporter in the presence of various concentrations of ribonucleotides. (C) Combined EiCsm6 and LwaCas13a activity with (A)6-(U)5 activator and poly-A/RNaseAlert reporter combination in the presence of various concentrations of ribonucleotides. (D) Combined EiCsm6 and LwaCas13a activity with (A)6-(U)5 activator and poly-A/5× RNaseAlert reporter combination in the presence of various concentrations of ribonucleotides. (E) Combined EiCsm6 and LwaCas13a activity with 5×(A)6-(U)5 activator and poly-A/RNaseAlert reporter combination in the presence of various concentrations of ribonucleotides. (F) Combined EiCsm6 and LwaCas13a activity with cyclic phosphate activator and poly-A/RNaseAlert reporter combination in the presence of various concentrations of ribonucleotides.

To couple the activity of Cas13 with Csm6 activation, Applicants designed protected RNA activators that contained a poly-A stretch followed by a protecting poly-U stretch that could be cleaved by a uracil preferring Cas13 enzyme, with the rationale that LwaCas13a could degrade all the uridines down to the homopolymeric A stretch since it had robust activity on UU and AU two-base motifs (FIG. 27). Applicants found that, upon addition of target and LwaCas13a-crRNA complex, EiCsm6 and LsCsm6 were activated by the $(A)_6$-$(U)_5$ activator, consistent with the finding that the A6 activator is optimal for Csm6 activation and confirmed by mass spectrometry (FIG. 25E and FIG. 32F, FIG. 33 and FIG. 34). Applicants combined the reporters for both Csm6 and Cas13 in the same reaction within the same fluorescence channel, and found that increasing the activator concentration increased the synergistic activation of Csm6 by Cas13 for DENV ssRNA detection (FIG. 25F), and that increasing the Csm6-specific polyA reporter also increased the Csm6 signal, leading to a larger increase in signal upon activator addition (FIG. 35A-B). After optimization (FIG. 36), Applicants found that Csm6-enhanced LwaCas13a increased the overall signal and kinetics of synthetic acyltransferase gene detection by SHERLOCK (FIG. 25G).

Figure 26:
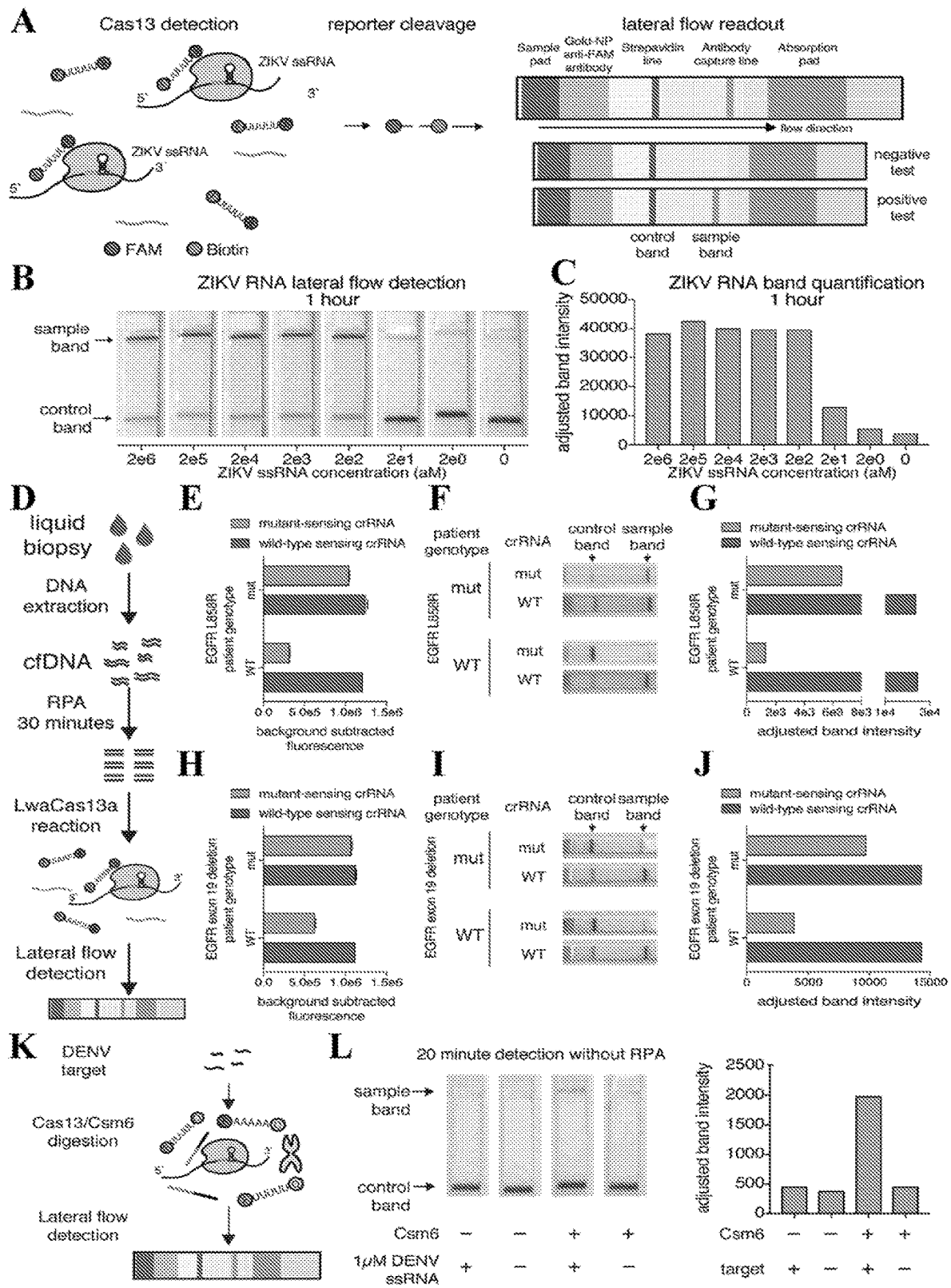
FIG. 26—Adapting SHERLOCK for lateral flow detection. A) Schematic of lateral flow detection with SHERLOCK. (B) Detection of synthetic ZIKV ssRNA using lateral flow SHERLOCK with 1 hour of LwaCas13a reaction. (C) Quantitation of band intensity from detection in (B). (D) Schematic of lateral flow detection of therapeutically relevant EGFR mutations from patient liquid biopsy samples. (E) Detection of EGFR L858R mutation in patient-derived cell-free DNA samples with either L858R or WT cancer mutations. Values represent mean+/−S.E.M. (F) Lateral-flow detection of EGFR L858R mutation in patient-derived cell-free DNA samples with either L858R or WT alleles. (G) Quantitation of band intensity from detection in (E). (H) Detection of EGFR exon 19 deletion mutation in patient-derived cell-free DNA samples with either exon 19 deletion or WT alleles. Values represent mean+/−S.E.M. (I) Lateral-flow detection of EGFR exon 19 deletion mutation in patient-derived cell-free DNA samples with either exon 19 deletion or WT alleles. (J) Quantitation of band intensity from detection in (H). (K) Schematic of lateral flow readout of EiCsm6-enhanced LwaCas13a detection of DENV ssRNA. (L) EiCsm6-enhanced lateral flow detection of synthetic DENV RNA in combination with LwaCas13a without preamplification by RPA. Band intensity quantitation is shown to the right.
Figure 37:
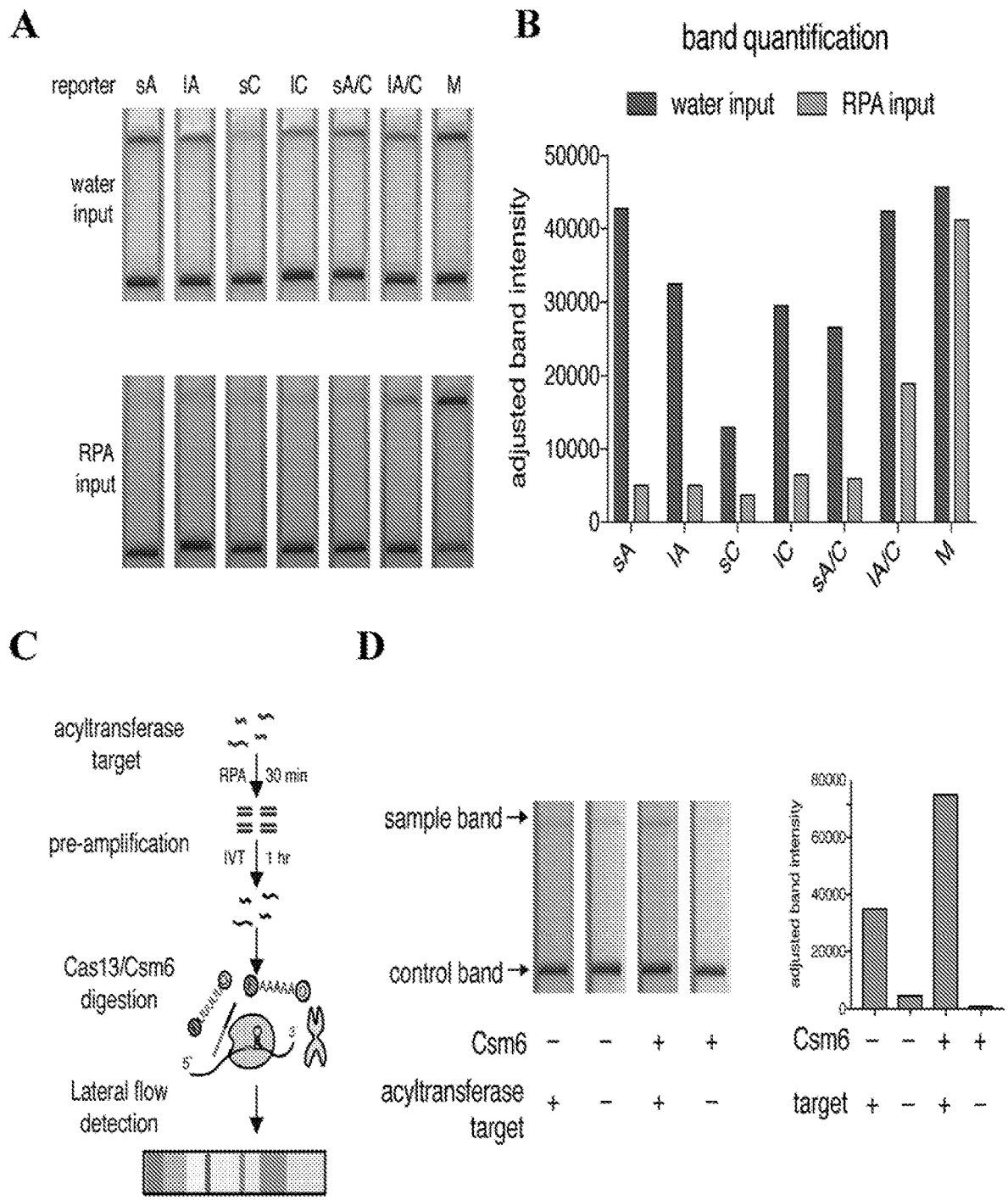
FIG. 37—Lateral flow Csm6-enhanced SHERLOCK with different reporter combinations. (A) Lateral-flow detection of Csm6-enhanced SHERLOCK with various reporter designs. sA: short poly-A sensor; 1A: long poly A sensor; sC: short poly C sensor; 1C: long poly C sensor; sA/C: short poly-A/C sensor; 1A/C: long poly-A/C sensor; M: mixed RNase alert-like sensor. (B) Quantitation of band intensity from detection in (A). (C) Schematic of lateral flow readout of EiCsm6-enhanced LwaCas13a SHERLOCK detection of acyltransferase ssDNA with separate RPA and IVT steps. (D) EiCsm6-enhanced lateral flow SHERLOCK of *P. aerunoginosa* acyltransferase gene in combination with LwaCas13a. Band intensity quantitation is shown to the right.

To improve the robustness of the detection and reduce the likelihood of false positive readout, Applicants combined Csm6 with Cas13 detection on lateral flow (FIG. 26K). Applicants tested lateral flow reporters of various sequence and length in the presence of Csm6 and activator, and found that a long A-C reporter demonstrated strong cleavage signal (FIG. 37A-B). Applicants used this reporter in combination with the Cas13 lateral flow reporter for rapid detection of DENV ssRNA relying solely on Csm6 for amplification (i.e., in the absence of RPA) (FIG. 26L). Applicants subsequently combined RPA, Cas13/Csm6, and lateral flow readout to detect an acyltransferase target, and found that the increase in signal conferred by Csm6 allowed for more rapid detection by lateral flow (FIG. 37C-D) with reduced background.

Materials and Methods
Protein Expression and Purification of Cas13 and Csm6 Orthologs LwaCas13a expression and purification was carried out as described before with minor modifications and is detailed below. LbuCas13a, LbaCas13a, Cas13b and Csm6 orthologs were expressed and purified with a modified protocol. In brief, bacterial expression vectors were transformed into Rosetta™ 2(DE3)pLysS Singles Competent Cells (Millipore). A 12.5 mL starter culture was grown overnight in Terrific Broth 4 growth media (Sigma) (TB), which was used to inoculate 4 L of TB for growth at 37° C. and 300 RPM until an OD600 of 0.5. At this time, protein expression was induced by supplementation with IPTG (Sigma) to a final concentration of 500 jaM, and cells were cooled to 18° C. for 16 h for protein expression. Cells were then centrifuged at 5000 g for 15 min at 4° C. Cell pellet was harvested and stored at −80° C. for later purification.

All subsequent steps of the protein purification were performed at 4° C. Cell pellet was crushed and resuspended in lysis buffer (20 mM Tris-HCl, 500 mM NaCl, 1 mM DTT, pH 8.0) supplemented with protease inhibitors (Complete Ultra EDTA-free tablets), lysozyme (500 μg/1 ml), and benzonase followed by high-pressure cell disruption using the LM20 Microfluidizer system at 27,000 PSI. Lysate was cleared by centrifugation for 1 hr at 4° C. at 10,000 g. The supernatant was applied to 5 mL of StrepTactin Sepharose (GE) and incubated with rotation for 1 hr followed by washing of the protein-bound StrepTactin resin three times in lysis buffer. The resin was resuspended in SUMO digest buffer (30 mM Tris-HCl, 500 mM NaCl 1 mM DTT, 0.15% Igepal (NP-40), pH 8.0) along with 250 Units of SUMO protease (250 mg/ml) and incubated overnight at 4° C. with rotation. The suspension was applied to a column for elution and separation from resin by gravity flow. The resin was washed two times with 1 column volume of Lysis buffer to maximize protein elution. The elute was diluted in cation exchange buffer (20 mM HEPES, 1 mM DTT, 5% glycerol, pH 7.0; pH 7.5 for LbuCas13a, LbaCas13a, EiCsm6, LsCsm6, TtCsm6) to lower the salt concentration in preparation for cation exchange chromatography to 250 mM.

For cation exchange and gel filtration purification, protein was loaded onto a 5 mL HiTrap SP HP cation exchange column (GE Healthcare Life Sciences) via FPLC (AKTA PURE, GE Healthcare Life Sciences) and eluted over a salt gradient from 250 mM to 2M NaCl in elution buffer (20 mM HEPES, 1 mM DTT, 5% glycerol, pH 7.0; pH 7.5 for LbuCas13a, LbaCas13a). The resulting fractions were tested for presence of recombinant protein by SDS-PAGE, and fractions containing the protein were pooled and concentrated via a Centrifugal Filter Unit (Millipore 50MWCO) to 1 mL in S200 buffer (10 mM HEPES, 1 M NaCl, 5 mM MgCl2, 2 mM DTT, pH 7.0). The concentrated protein was loaded onto a gel filtration column (Superdex® 200 Increase 10/300 GL, GE Healthcare Life Sciences) via FPLC. The resulting fractions from gel filtration were analyzed by SDS-PAGE and fractions containing protein were pooled and buffer exchanged into Storage Buffer (600 mM NaCl, 50 mM Tris-HCl pH 7.5, 5% glycerol, 2 mM DTT) and frozen at −80° C. for storage.

Accession numbers and plasmid maps for all proteins purified in this study are available in FIG. 39.

Nucleic Acid Target and crRNA Preparation

Nucleic acid targets for Cas12a and genomic DNA detection were PCR amplified with NEBNext PCR master mix, gel extracted, and purified using MinElute gel extraction kit (Qiagen). For RNA based detection, purified dsDNA was incubated with T7 polymerase overnight at 30° C. using the HiScribe T7 Quick High Yield RNA Synthesis kit (New England Biolabs) and RNA was purified with the MEGAclear Transcription Clean-up kit (Thermo Fisher).

crRNA preparation was carried out as described before with minor modifications and is detailed below. For preparation of crRNAs, constructs were ordered as ultramer DNA (Integrated DNA Technologies) with an appended T7 promoter sequence. crRNA DNA was annealed to a short T7 primer (final concentrations 10 uM) and incubated with T7 polymerase overnight at 37° C. using the HiScribe T7 Quick High Yield RNA Synthesis kit (New England Biolabs). crRNAs were purified using RNAXP clean beads (Beckman Coulter) at 2× ratio of beads to reaction volume, with an additional 1.8× supplementation of isopropanol (Sigma).

All crRNA sequences used in this study are available in FIG. 40. All DNA and RNA target sequences used in this study are available in FIG. 41.

Primers for RPA were designed using NCBI Primer-BLAST using default parameters, with the exception of amplicon size (between 100 and 140 nt), primer melting temperatures (between 54° C. and 67° C.), and primer size (between 30 and 35 nt). Primers were then ordered as DNA (Integrated DNA Technologies).

RPA and RT-RPA reactions run were as instructed with TwistAmp® Basic or TwistAmp® Basic RT (TwistDx), respectively, with the exception that 280 mM MgAc was added prior to the input template. Reactions were run with 1 μL of input for 1 hr at 37° C., unless otherwise described.

For SHERLOCK quantification of nucleic acid, RPA primer concentration tested at standard concentration (480 nM final) and lower (240 nM, 120 nM, 60 nM, 24 nM) to find the optimum concentration. RPA reactions were further run for 20 minutes.

When multiple targets were amplified with RPA, primer concentration was adjusted to a final concentration of 480 nM. That is, 120 nM of each primer for two primer pairs were added for duplex detection.

All RPA primers used in this study are available in FIG. 42.

Fluorescent Cleavage Assay

Detection assays were carried out as described before with minor modifications and the procedure is detailed below. Detection assays were performed with 45 nM purified Cas13, 22.5 nM crRNA, quenched fluorescent RNA reporter (125 nM RNAse Alert v2, Thermo Scientific, homopolymer and di-nucleotide reporters (IDT); 250 nM for polyA Trilink reporter), 0.5 μL murine RNase inhibitor (New England Biolabs), 25 ng of background total human RNA (purified from HEK293FT culture), and varying amounts of input nucleic acid target, unless otherwise indicated, in nuclease assay buffer (20 mM HEPES, 60 mM NaCl, 6 mM MgCl2, pH 6.8). For Csm6 fluorescent cleavage reactions, protein was used at 10 nM final concentration along with 500 nM of 2', 3' cyclic phosphate oligoadenylate, 250 nM of fluorescent reporter, and 0.5 μL murine RNase inhibitor in nuclease assay buffer (20 mM HEPES, 60 mM NaCl, 6 mM MgCl2, pH 6.8). Reactions were allowed to proceed for 1-3 hr at 37° C. (unless otherwise indicated) on a fluorescent plate reader (BioTek) with fluorescent kinetics measured every 5 min. In reactions involving AsCas12a, 45 nM AsCas12a was included using recombinant protein from IDT. In the case of multiplexed reactions, 45 nM of each protein and 22.5 nM of each crRNA was used in the reaction.

All cleavage reporters used in this study are available in FIG. 43.

SHERLOCK Nucleic Acid Detection

Detection assays were performed with 45 nM purified Cas13, 22.5 nM crRNA, quenched fluorescent RNA reporter (125 nM RNAse Alert v2, Thermo Scientific, homopolymer and di-nucleotide reporters (IDT), 250 nM for polyA Trilink reporter), 0.5 μL murine RNase inhibitor (New England Biolabs), 25 ng of background total human RNA (purified from HEK293FT culture), and 1 uL of RPA reaction in nuclease assay buffer (20 mM HEPES, 60 mM NaCl, 6 mM MgCl2, pH 6.8), rNTP mix (1 mM final, NEB), 0.6 μL T7 polymerase (Lucigen) and 3 mM MgCl2. Reactions were allowed to proceed for 1-3 hr at 37° C. (unless otherwise indicated) on a fluorescent plate reader (BioTek) with fluorescent kinetics measured every 5 min.

For one-pot nucleic acid detection, the detection assay was carried out as described before with minor modifications. A single 100 μL combined reaction assay consisted of 0.48 μM forward primer, 0.48 μM reverse primer, 1×RPA rehydration buffer, varying amounts of DNA input, 45 nM LwCas13a recombinant protein, 22.5 nM crRNA, 125 ng background total human RNA, 125 nM substrate reporter (RNase alert v2), 2.5 μL murine RNase inhibitor (New England Biolabs), 2 mM ATP, 2 mM GTP, 2 mM UTP, 2 mM CTP, 1 μL T7 polymerase mix (Lucigen), 5 mM MgCl2, and 14 mM MgAc. Reactions were allowed to proceed for 1-3 hr at 37° C. (unless otherwise indicated) on a fluorescent plate reader (BioTek) with fluorescent kinetics measured every 5 min. For lateral flow readout, 20 uL of the combined reaction was added to 100 uL of HybriDetect 1 assay buffer (Milenia) and run on HybriDetect 1 lateral flow strips (Milenia).

Nucleic Acid Labeling for Cleavage Fragment Analysis

Target RNA was in vitro transcribed from a dsDNA template and purified as described above. The in vitro cleavage reaction was performed as described above for fluorescence cleavage reaction with the following modifications. Fluorescence reporter was substituted for 1 μg RNA target and no background RNA was used. Cleavage reaction was carried out for 5 minutes (LwaCas13a) or 1 hour (PsmCas13b) at 37° C. The cleavage reaction was purified using the RNA clean & concentrator-5 kit (Zymo Research) and eluted in 10 uL UltraPure water (Gibco). Cleavage reaction was further labeled with a 10 μg of maleimide IRDye 800CW (Licor) following the 5'EndTag labeling Reaction (Vector Laboratories) kit protocol. To determine the 5' end produced by Cas13 cleavage, the protocol was modified to either perform an Alkaline Phosphatase (AP) treatment or substitute with UltraPure water to only label 5'-OH containing RNA species, while undigested triphosphorylated (PPP) RNA species are only labeled when AP treatment is performed.

Mass Spectrometry for High Resolution Cleavage Fragment Analysis

For determining the cleavage ends produced by Cas13 collateral RNase activity by Mass Spectrometry, an in vitro cleavage reaction was performed as described above with the following modifications. Cas13 RNA target was used at 1 nM final concentration, Csm6 activator at 3 μM final concentration and no background RNA was used. For control reactions, either Cas13 target was substituted by UltraPure water, or standard in vitro cleavage reaction was incubated with hexaadenylate containing a 2', 3'cyclic phosphate activator in the absence of Cas13 target, Cas13 protein and Cas13 crRNA. The cleavage reactions were carried out for 1 h at 37° C. and purified using an New England Biolabs siRNA purification protocol. In brief, one-tenth volume of 3 M NaOAc, 2 μL of RNase-free Glycoblue (Thermofisher) and three volumes of cold 95% ethanol was added, placed at −20° C. for 2 hours, and centrifuged for 15 minutes at 14,000 g. The supernatant was removed and two volumes of 80% EtOH was added and incubated for 10 minutes at room temperature. The supernatant was decanted and samples centrifuged for 5 minutes at 14,000 g. After air-drying the pellet, 50 μL of UltraGrade water added and sent on dry ice for Mass spectrometry analysis.

For mass spectrometry analysis, samples were diluted 1:1 with UltraGrade water and analyzed on Bruker Impact II q-TOF mass spectrometer in negative ion mode coupled to an Agilent 1290 HPLC. 10 μL were injected onto a PLRP-S column (50 mm, 5 um particle size, 1000 angstrom pore size PLRP-S column, 2.1 mm ID) using 0.1% ammonium hydroxide v/v in water as mobile phase A and acetonitrile as mobile phase B. The flow rate was kept constant throughout at 0.3 ml/minute. The mobile phase composition started at 0% B and was maintained for the first 2 minutes. After this point, the composition was changed to 100% B over the next 8 minutes and maintained for one minute. The composition was then returned to 0% B over 0.1 minute and then maintained for the following 4.9 minutes to allow the column to re-equilibrate to starting conditions. The mass spectrometer was tuned for large MW ions, and data was acquired between m/z 400-5000. The entire dataset from the mass spectrometer was calibrated by m/z using an injection of sodium formate. Data was analyzed using Bruker Compass Data Analysis 4.3 with a license for MaxEnt deconvolution algorithm to generate a calculated neutral mass spectrum from the negatively charged ion data.

Genomic DNA Extraction from Human Saliva

Saliva DNA extraction was carried out as described before with minor modifications and is detailed below. 2 mL of saliva was collected from volunteers, who were restricted from consuming food or drink 30 min prior to collection. Samples were then processed using QIAamp® DNA Blood Mini Kit (Qiagen) as recommended by the kit protocol. For boiled saliva samples, 400 µL of phosphate buffered saline (Sigma) was added to 100 µL of volunteer saliva and centrifuged for 5 min at 1800 g. The supernatant was decanted and the pellet was resuspended in phosphate buffered saline with 0.2% Triton X-100 (Sigma) before incubation at 95° C. for 5 min. 1 µL of sample was used as direct input into RPA reactions.

Digital Droplet PCR Quantification ddPCR quantification was carried out as described before with minor modifications and is detailed below. To confirm the concentration of target dilutions, we performed digital-droplet PCR (ddPCR). For DNA quantification, droplets were made using the ddPCR Supermix for Probes (no dUTP) (BioRad) with PrimeTime qPCR probes/primer assays (IDT) designed for the target sequence. For RNA quantification, droplets were made using the one-step RT-ddPCR kit for probes with PrimeTime qPCR probes/primer assays designed for the target sequence. Droplets were generated in either case using the QX200 droplet generator (BioRad) and transferred to a PCR plate. Droplet-based amplification was performed on a thermocycler as described in the kit protocol and nucleic acid concentrations were subsequently determined via measurement on a QX200 droplet reader.

Cas13-Csm6 Fluorescent Cleavage Assay

Cas13-Csm6 combined fluorescent cleavage assays were performed as described for standard Cas13 fluorescent cleavage reactions with the following modifications. Csm6 protein was added to 10 nM final concentration, 400 nM of Csm6 fluorescent reporter and 500 nM Csm6 activator unless otherwise indicated. For distinguishing Cas13 from Csm6 collateral RNase activity, two distinct fluorophores were used for fluorescence detection (FAM and HEX). Because of the interference of rNTPs with Csm6 activity, the IVT was performed in the RPA pre-amplification step and then 1 µL of this reaction was added as input to the Cas13-Csm6 cleavage assay.

In the case where we tested a three-step Cas13-Csm6 cleavage assay, the RPA was performed normally as discussed above for varying times and then used as input to a normal IVT reaction for varying times. Then 1 µL of the IVT was used as input to the Cas13-Csm6 reaction described in the previous paragraph. All Csm6 activators used in this study are available in FIG. 38.

Motif Discovery Screen with Library

To screen for Cas13 cleavage preference, an in vitro RNA cleavage reaction was set up as described above with the following modifications. Cas13 target was used at 20 nM, fluorescent reporter was substituted for 1 µM of DNA-RNA oligonucleotide (IDT) that contains a 6-mer stretch of randomized ribonucleotides flanked by DNA handles for NGS library preparation. Reactions were carried out for 60 minutes (unless otherwise indicated) at 37° C. The reactions were purified using the Zymo oligo-clean and concentrator-5 kit (Zymo research) and 15 µL of UltraPure water was used for elution. 10 µL of purified reaction was used for reverse transcription using a gene-specific primer that binds to the DNA handle.

Reverse transcription (RT) was carried out for 45 minutes at 42° C. according to the qScript Flex cDNA-kit (quantabio) protocol. To assess cleavage efficiency and product purity, RT-reactions were diluted 1:10 in water and loaded on a Small RNA kit and run on a Bioanalyzer 2100 (Agilent). Four microliters of RT-reaction was used for the first-round of NGS library preparation. NEBNext (NEB) was used to amplify first strand cDNA with a mix of forward primers at 625 nM final and a reverse primer at 625 nM for 15 cycles with 3 minute initial denaturation at 98° C., 10 s cycle denaturation at 98° C., 10 s annealing at 63° C., 20 s 72° C. extension and 2 minute final extension at 72° C.

Two microliters of first round PCR reaction was used for second round PCR amplification to attach Illumina-compatible indices (NEB) for NGS sequencing. The same NEBNext PCR protocol was used for amplification. PCR product were analyzed by agarose gel-electrophoresis (2% Sybr Gold E-Gel Invitrogen system) and 5 µL of each reaction was pooled. The pooled samples was gel extracted, quantified with Qubit DNA 2.0 DNA High sensitivity kit and normalized to 4 nM final concentration. The final library was diluted to 2 pM and sequenced on a NextSeq 500 Illumina system using a 75-cycle kit.

Motif Screen Analysis

To analyze depletion of preferred motifs from the random motif library screen, 6-mer regions were extracted from sequence data and normalized to overall read count for each sample. Normalized read counts were then used to generated log ratios, with pseudocount adjustment, between experimental conditions and matched controls. For Cas13 experiments, matched controls did not have target RNA added; for Csm6 and RNase A experiments, matched controls did not have enzyme. Log ratio distribution shape was used to determine cut-offs for enriched motifs. Enriched motifs were then used to determine occurrence of 1-, 2-, or 3-nucleotide combinations. Motif logos were generated using Weblogo3.

Phylogenetic Analysis of Cas13 Protein and crRNA Direct Repeats

To study ortholog clustering, multiple sequence alignments were generated with Cas13a and Cas13b protein sequences in Geneious with MUSCLE and then clustered using Euclidean distance in R with the heatmap.2 function. To study direct repeat clustering, multiple sequence alignments were generated with Cas13a and Cas13b direct repeat sequences in Geneious using the Geneious algorithm and then clustered using Euclidean distance in R with the heatmap.2 function. To study clustering of orthologs based on di-nucleotide motif preference, the cleavage activity matrix was clustered using Euclidean distance in R using the heatmap.2 function.

Gold Nanoparticle Colorimetric

An RNA oligo was synthesized from IDT with thiols at the 5' and 3' ends (FIG. 43 for sequence). In order to deprotect the thiol groups, the oligo at a final concentration of 20 mM was reduced in 150 mM sodium phosphate buffer containing 100 mM DTT for 2 hours at room temperature. The oligo were then purified using sephadex NAP-5 columns (GE Healthcare) into a final volume of 700 µL water. As previously described, the reduced oligo at 10 µM was added at a volume of 280 µL to 600 µL of 2.32 nM 15 nm-gold nanoparticles (Ted Pella), which is a 2000:1 ratio of oligo to nanoparticles. Subsequently, 10 µL of 1M Tris-HCl at pH8.3 and 90 µL of 1M NaCl were added to the oligo-nanoparticle mixture and incubated for 18 hours at room temperature with rotation. After 18 hours, additional 1M Tris-HCl (5 µL at pH8.3) was added with 5M NaCl (50 µL) and this was incubated for an additional 15 hours at room temperature with rotation. Following incubation, the final solution was centrifuged for 25 min at 22,000 g. The supernatant was discarded and the conjugated nanoparticles were resuspended in 50 µL of 200 mM NaCl.

The nanoparticles were tested for RNase sensitivity using an RNase A assay. Varying amounts of RNase A (Thermo Fischer) were added to 1× RNase A buffer and 6 µL of conjugated nanoparticles in a total reaction volume of 20 µL. Absorbance at 520 nm was monitored every 5 minutes for 3 hours using a plate spectrophotometer.

Lateral Flow Readout of Cas13 Activity Using FAM-Biotin Reporters

For lateral flow based on cleavage of a FAM-RNA-biotin reporter, non-RPA LwaCas13a reactions or SHERLOCK-LwaCas13a reactions were run for 1 hour, unless otherwise indicated, with 1 uM final concentration of FAM-RNA-biotin reporter. After incubation, 20 uL LwaCas13a reactions supernatant was added to 100 uL of HybriDetect 1 assay buffer (Milenia) and run on HybriDetect 1 lateral flow strips (Milenia).

Cloning of REPAIR Constructs, Mammalian Cell Transfection, RNA Isolation and NGS Library Preparation for REPAIR Constructs for simulating reversion of APC mutations and guide constructs for REPAIR were cloned as previously described. Briefly, 96 nt sequences centered on the APC:c.1262G>A mutation were designed and golden gate cloned under an expression vector, and corresponding guide sequences were golden gate cloned into U6 expression vectors for PspCas13b guides. To simulate patient samples, 300 ng of either mutant or wildtype APC expression vector was transfected into HEK293FT cells with Lipofectamine 2000 (Invitrogen), and two days post-transfection DNA was harvested with Qiamp DNA Blood Midi Kit (Qiagen) following manufacturer's instructions. 20 ng of DNA were used as input into SHERLOCK-LwaCas13a reactions.

RNA correction using the REPAIR system was performed as previously described: 150 ng of dPspCas13b-ADAR(DD) E488Q, 200 ng of guide vector, and 30 ng of APC expression vector were co-transfected, and two-days post transfection RNA was harvested using the RNeasy Plus Mini Kit (Qiagen) following manufacturer's instructions. 30 ng of RNA was used as input into SHERLOCK-LwaCas13a reactions.

RNA editing fractions were independently determined by NGS as previously described. RNA was reverse transcribed with the qScript Flex kit (Quanta Biosciences) with a sequence specific primer. First strand cDNA was amplified with NEBNext High Fidelity 2× PCR Mastermix (New England Biosciences) with a mix of forward primers at 625 nM final and a reverse primer at 625 nM for 15 cycles with 3 minute initial denaturation at 98° C., 10 second cycle denaturation at 98° C., 30 second annealing at 65° C., 30 second 72° C. extension and 2 minute final extension at 72° C. Two microliters of first round PCR reaction was used for second round PCR amplification to attach Illumina-compatible indices for NGS sequencing, with NEBNext, using the same protocol with 18 cycles. PCR products were analyzed by agarose gel-electrophoresis (2% Sybr Gold E-Gel Invitrogen) and 5 µL of each reaction was pooled. The pooled samples was gel extracted, quantified with Qubit DNA 2.0 DNA High sensitivity kit and normalized to 4 nM final concentration, and read out with a 300 cycle v2 MiSeq kit (Illumina).

Analysis of SHERLOCK Fluorescence Data

SHERLOCK fluorescence analysis was carried out as described before with minor modifications and is detailed below. To calculate background subtracted fluorescence data, the initial fluorescence of samples was subtracted to allow for comparisons between different conditions. Fluorescence for background conditions (either no input or no crRNA conditions) were subtracted from samples to generate background subtracted fluorescence.

crRNA ratios for SNP discrimination were calculated to adjust for sample-to-sample overall variation as follows:

$$crRNAA_i \text{ ratio} = \frac{(m+n)A_i}{\sum_{i=1}^{m} A_i + \sum_{i=1}^{n} B_i}$$

where $A_i$ and $B_i$ refer to the SHERLOCK intensity values for technical replicate i of the crRNAs sensing allele A or allele B, respectively, for a given individual. Since we typically have four technical replicates per crRNA, m and n are equal to 4 and the denominator is equivalent to the sum of all eight of the crRNA SHERLOCK intensity values for a given SNP locus and individual. Because there are two crRNAs, the crRNA ratio average across each of the crRNAs for an individual will always sum to two. Therefore, in the ideal case of homozygosity, the mean crRNA ratio for the positive allele crRNA will be two and the mean crRNA ratio for the negative allele crRNA will be zero. In the ideal case of heterozygosity, the mean crRNA ratio for each of the two crRNAs will be one. Because in SHERLOCKv2, we accomplish genotyping by measuring $A_i$ and $B_i$ in different color channels, we scaled the 530-color channel by 6 to match the intensity values in the 480-color channel.

Promiscuous Cleavage of Cas13 Orthologs in Absence of Target

Some members of the Cas13 family, such as PinCas13b and LbuCas13a, demonstrate promiscuous cleavage in the presence or absence of target, and this background activity is di-nucleotide reporter dependent This background activity was also spacer dependent for LbuCas13a. In some reporters, the U and A base preference clustered within protein or DR similarity. Interestingly, di-nucleotide preferences identified here did not correspond with Cas13 families clustered from either direct repeat similarity or protein similarity.

Characterization of crRNA Designs for PsmCas13b and CcaCas13b

To identify the optimal crRNA for detection with PsmCas13b and CcaCas13b, we tested crRNA spacer lengths from 34-12 nt and found that PsmCas13b had a peak sensitivity at a spacer length of 30, whereas CcaCas13b had equivalent sensitivity above spacer lengths of 28 nt, justifying the use of 30 nt spacers for evaluating Cas13 activity. To further explore the robustness of targeting of CcaCas13b and PsmCas13b compared to LwaCas13a, we designed eleven different crRNAs evenly spaced across ssRNA 1 and found that LwaCas13a collateral activity was robust to crRNA design, while CcaCas13b and PsmCas13b both showed more variability in activity across different crRNAs.

Random library motif screening for additional orthogonal motifs To further explore the diversity of cleavage preferences of Cas13a and Cas13b orthologs, we developed a library-based approach for characterizing preferred motifs for collateral endonuclease activity. We used a degenerate 6-mer RNA reporter flanked by constant DNA handles, which allowed for amplification and readout of uncleaved sequences. Incubating this library with Cas13 enzymes resulted in detectable cleavage patterns that depended on the addition of target RNA, and sequencing of depleted motifs from these reactions revealed an increase in the skew of the library over digestion time indicative of a population of preferred motifs for cleavage. Sequence logos and pairwise base preferences from highly depleted motifs reproduced the U-preference observed for LwaCas13a and CcaCas13b and the A-preference of PsmCas13b). We synthesized reporters from top motifs as determined from the screen to validate the findings, and found that LwaCas13a, CcaCas13a, and PsmCas13b all cleaved their most highly preferred motifs). We also found multiple sequences that showed cleavage for only one ortholog, but not others, which could allow for an alternative orthogonal readout from di-nucleotide motifs. LwaCas13a incubated with different targets produced similar cleavage motif preferences, indicating that the base preference of the collateral activity is constant regardless of target sequence.

Validation of Activator Products Upon LwaCas13a Cleavage

Using mass spectrometry, we verified that LwaCas13a digestion produced the expected cyclic-phosphate terminated products for Csm6 activation. Activation was most effective for designs with 3' protection with poly U, as other activation designs, including 5' protection with poly-U and internal poly-U tracts, were less effective at activating Csm6 exclusively in the presence of target RNA (likely because LwaCas13a has little activity on UA motifs and 5' protection is ineffective at preventing activation of Csm6).

Optimization for Combining RPA and Csm6 Reactions

As combining Csm6-enhancement with RPA pre-amplification would increase signal and sensitivity, we tested Csm6 for activity in the presence of in vitro transcription components necessary for combination with RPA. We found that both magnesium and free rNTP reduced the nuclease activity of Csm6 in the presence of a cyclic phosphate activator. Reducing the amount of rNTP in solution reduced the amount of transcribed RNA, and therefore had a negative effect on Csm6 activation by Cas13a, even in the presence of increased reporter or activator concentrations.

The invention is further described by the following numbered paragraphs:

1. A composition comprising one or more detection CRISPR effector protein and one or more signal amplification CRISPR effector protein.

2. The composition of paragraph 1, wherein the one or more detection CRISPR effector protein is a Type VI CRISPR effector protein.

3. The composition of paragraph 2, wherein the Type VI CRISPR effector protein is a Cas13a, Cas13b, or both.

4. The composition of anyone of the preceding paragraphs, wherein the one or more signal amplification CRISPR effector proteins are Type IIIa CRISPR proteins.

5. The composition of paragraph 4, wherein the Type III CRISPR protein is a Csm6 protein.

6. The composition of any one of the preceding paragraphs, further comprising one or more guide sequences designed to binding to corresponding target molecules.

7. The composition of paragraph 7, further comprising one or more activation sequences designed to activate the one or more signal amplification CRISPR effector proteins upon cleavage of the activation sequences.

8. The composition of any one of the preceding paragraphs further comprising a reporter construct.

9. The composition of any one of the preceding paragraphs further comprising a protected secondary guide sequence and a secondary target sequence, wherein the secondary guide sequence is designed to bind the secondary target sequence upon removal of a protecting element on the protected secondary guide sequence.

10. The composition of any one of the preceding paragraphs, further comprising a protected secondary target sequence and a secondary guide sequence, wherein the secondary guide sequence is designed to bind to the secondary target sequence upon removal of a protecting element on the protected secondary target sequence.

11. The composition of any one of the preceding paragraphs, further comprising a protected or circularized primer and a template encoding guide sequence and/or target sequence, wherein the protected or circularized primer is designed to prime an amplification reaction of the template upon removal of a protecting element or cleavage of the circularized primer.

12. The composition of anyone of the preceding paragraphs further comprising amplification reagents.

13. A diagnostic device comprising the composition of any one of paragraphs 1 to 12.

14. A method for detecting target molecules in samples, comprising;
   distributing a sample or set of samples into one or more individual discrete volumes, the individual discrete volumes comprising a composition of anyone of paragraphs 8 to 12;
   incubating the sample or set of samples under conditions sufficient to allow binding of the one or more guide sequences to one or more target molecules;
   activating the detection CRISPR effector protein via binding of the one or more guide sequences to the one or more target molecules, wherein activating the detection CRISPR effector protein results in cleavage of the activation sequence such that the signal amplification CRISPR effector protein is activated, and wherein both the activated detection CRISPR effector protein and the activated signal amplification CRISPR effector protein modify the reporter construct such that detectable positive signal is generated; and
   detecting the detectable positive signal, wherein detection of the detectable positive signal indicates a presence of one or more target molecules in the sample.

Various modifications and variations of the described methods, pharmaceutical compositions, and kits of the invention will be apparent to those skilled in the art without departing from the scope and spirit of the invention. Although the invention has been described in connection with specific embodiments, it will be understood that it is capable of further modifications and that the invention as claimed should not be unduly limited to such specific embodiments. Indeed, various modifications of the described modes for carrying out the invention that are obvious to those skilled in the art are intended to be within the scope of the invention. This application is intended to cover any variations, uses, or adaptations of the invention following, in general, the principles of the invention and including such departures from the present disclosure come within known customary practice within the art to which the invention pertains and may be applied to the essential features herein before set forth.

SEQUENCE LISTING (574 sequences)

SEQ ID NO: 1 - protein, 1434 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTLKRPAATKKAGQAKKKKGSYPYDVPDYAYPYDVPDYAYPYDVPDYA

SEQ ID NO: 2 - protein, 1197 aa, Leptotrichia wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEKRPAATKKAGQAKKKKGSYPYDVPDYAYPYDVPDYAYPYDVPDYA

SEQ ID NO: 3 - protein, 1120 aa, Listeria seeligeri
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 4 - protein, 1340 aa, Lachnospiraceae bacterium MA2020
MQISKVNHKHVAVGQKDRERITGFIYNDPVGDEKSLEDVVAKRANDTKVLFNVFNTKDLYDSQESDKSEKDKEIISKGAKFVAKSFNSAITILKKQNKIYSTLTSQQVIKELKDKFGGARIYDDDIEEALTETLKKSFRKENVRNSIKVLIENAAGIRSSLSKDEEELIQEYFVKQLVEEYTKTKLQKNVVKSIKNQNMVIQPDSDSQVLSLSESRREKQSSAVSSDTLVNCKEKDVLKAFLTDYAVLDEDERNSLLWKLRNLVNLYFYGSESIRDYSYTKEKSVWKEHDEQKANKTLFIDEICHITKIGKNGKEQKVLDYEENRSRCRKQNINYYRSALNYAKNNTSGIFENEDSNHFWIHLIENEVERLYNGIENGEEFKFETGYISEKVWKAVINHLSIKYIALGKAVYNYAMKELSSPGDIEPGKIDDSYINGITSFDYEIIKAEESLQRDISMNVVFATNYLACATVDTDKDFLLFSKEDIRSCTKKDGNLCKNIMQFWGGYSTWKNFCEEYLKDDKDALELLYSLKSMLYSMRNSSFHFSTENVDNGSWDTELIGKLFEEDCNRAARIEKEKFYNNNLHMFYSSSLLEKVLERLYSSHHERASQVPSFNRVFVRKNFPSSLSEQRITPKFTDSKDEQIWQSAVYYLCKEIYYNDFLQSKEAYKLFREGVKNLDKNDINNQKAADSFKQAVVYYGKAIGNATLSQVCQAIMTEYNRQNNDGLKKKSAYAEKQNSNKYKHYPLFLKQVLQSAFWEYLDENKEIYGFISAQIHKSNVEIKAEDFIANYSSQQYKKLVDKVKKTPELQKWYTLGRLINPRQANQFLGSIRNYVQFVKDIQRRAKENGNPIRNYYEVLESDSIIKILEMCTKLNGTTSNDIHDYFRDEDEYAEYISQFVNFGDVHSGAALNAFCNSESEGKKNGIYYDGINPIVNRNWVLCKLYGSPDLISKIISRVNENMIHDFHKQEDLIREYQIKGICSNKKEQQDLRTFQVLKNRVELRDIVEYSEIINELYGQLIKWCYLRERDLMYFQLGFHYLCLNNASSKEADYIKINVDDRNISGAILYQIAAMYINGLPVYYKKDDMYVALKSGKKASDELNSNEQTSKKINYFLKYGNNILGDKKDQLYLAGLELFENVAEHENIIIFRNEIDHFHYFYDRDRSMLDLYSEVFDRFFTYDMKLRKNVVNMLYNILLDHNIVSSFVFETGEKKVGRGDSEVIKPSAKIRLRANNGVSSDVFTYKVGSKDELKIATLPAKNEEFLLNVARLIYYPDMEAVSENMVREGVVKVEKSNDKKGKISRGSNTRSSNQSKYNNKSKNRMNYSMGSIFEKMDLKFD

SEQ ID NO: 5 - protein, 1437 aa, Lachnospiraceae bacterium NK4A179
MKISKVREENRGAKLTVNAKTAVVSENRSQEGILYNDPSRYGKSRKNDEDRDRYIESRLKSSGKLYRIFNEDKNKRETDELQWFLSEIVKKINRRNGLVLSDMLSVDDRAFEKAFEKYAELSYTNRRNKVSGSPAFETCGVDAATAERLKGIISETNFINRIKNNIDNKVSEDIIDRIIAKYLKKSLCRERVKRGLKKLLMNAFDLPYSDPDIDVQRDFIDYVLEDFYHVRAKSQVSRSIKNMNMPVQPEGDGKFAITVSKGGTESGNKRSAEKEAFKKFLSDYASLDERVRDDMLRRMRRLVVLYFYGSDDSKLSDVNEKFDVWEDHAARRVDNREFIKLPLENKLANGKTDKDAERIRKNTVKELYRNQNIGCYRQAVKAVEEDNNGRYFDDKMLNMFFIHRIEYGVEKIYANLKQVTEFKARTGYLSEKIWKDLINYISIKYIAMGKAVYNYAMDELNASDKKEIELGKISEEYLSGISSFDYELIKAEEMLQRETAVYVAFAARHLSSQTVELDSENSDFLLLKPKGTMDKNDKNKLASNNILNFLKDKETLRDTILQYFGGHSLWTDFPFDKYLAGGKDDVDFLTDLKDVIYSMRNDSFHYATENHNNGKWNKELISAMFEHETERMTVVMKDKFYSNNLPMFYKNDDLKKLLIDLYKDNVERASQVPSFNKVFVRKNFPALVRDKDNLGIELDLKADADKGENELKFYNALYYMFKEIYYNAFLNDKNVRERFITKATKVADNYDRNKERNLKDRIKSAGSDEKKKLREQLQNYIAENDFGQRIKNIVQVNPDYTLAQICQLIMTEYNQQNNGCMQKKSAARKDINKDSYQHYKMLLLVNLRKAFLEFIKENYAFVLKPYKHDLCDKADFVPDFAKYVKPYAGLISRVAGSSELQKWYIVSRFLSPAQANHMLGFLHSYKQYVWDIYRRASETGTEINHSIAEDKIAGVDITDVDAVIDLSVKLCGTISSEISDYFKDDEVYAEYISSYLDFEYDGGNYKDSLNRFCNSDAVNDQKVALYYDGEHPKLNRNIILSKLYGERRFLEKITDRVSRSDIVEYYKLKKETSQYQTKGIFDSEDEQKNIKKFQEMKNIVEFRDLMDYSEIADELQGQLINWIYLRERDLMNFQLGYHYACLNNDSNKQATYVTLDYQGKKNRKINGAILYQICAMYINGLPLYYVDKDSSEWTVSDGKESTGAKIGEFYRYAKSFENTSDCYASGLEIFENISEHDNITELRNYIEHFRYYSSFDRSFLGIYSEVFDRFFTYDLKYRKNVPTILYNILLQHFVNVRFEFVSGKKMIGIDKKDRKIAKEKECARITIREKNGVYSEQFTYKLKNGTVYVDARDKRYLQSIIRLLFYPEKVNMDEMIEVKEKKKPSDNNTGKGYSKRDRQQDRKEYDKYKEKKKKEGNFLSGMGGNINWDEINAQLKN

SEQ ID NO: 6 - protein, 1385 aa, Clostridium aminophilum DSM10710
MKFSKVDHTRSAVGIQKATDSVHGMLYTDPKKQEVNDLDKRFDQLNVKAKRLYNVFNQSKAEEDDDEKRFGKVVKKLNRELKDLLFHREVSRYNSIGNAKYNYYGIKSNPEEIVSNLGMVESLKGERDPQKVISKLLLYYLRKGLKPGTDGLRMILEASCGLRKLSGDEKELKVFLQTLDEDFEKKTFKKNLIRSIENQNMAVQPSNEGDPIIGITQGRFNSQKNEEKSAIERMMSMYADLNEDHREDVLRKLRRLNVLYFNVDTEKTEEPTLPGEVDTNPVFEVWHDHEKGKENDRQFATFAKILTEDRETRKKEKLAVKEALNDLKSAIRDHNIMAYRCSIKVTEQDKDGLFFEDQRINRFWIHHIESAVERILASINPEKLYKLRIGYLGEKVWKDLLNYLSIKYIAVGKAVFHFAMEDLGKTGQDIELGKLSNSVSGGLTSFDYEQIRADETLQRQLSVEVAFAANNLFRAVVGQTGKKIEQSKSEENEEDFLLWKAEKIAESIKKEGEGNTLKSILQFFGGASSWDLNHFCAAYGNESSALGYETKFADDLRKAIYSLRNETFHFTTLNKGSFDWNAKLIGDMFSHEAATGIAVERTRFYSNNLPMFYRESDLKRIMDHLYNTYHPRASQVPSFNSVFVRKNFRLFLSNTLNTNTSFDTEVYQKWESGVYYLFKEIYYNSFLPSGDAHHLFFEGLRRIRKEADNLPIVGKEAKKRNAVQDFGRRCDELKNLSLSAICQMIMTEYNEQNNGNRKVKSTREDKRKPDIFQHYKMLLLRTLQEAFAIYIRREEFKFIFDLPKTLYVMKPVEEFLPNWKSGMFDSLVERVKQSPDLQRWYVLCKFLNGRLLNQLSGVIRSYIQFAGDIQRRAKANHNRLYMDNTQRVEYYSNVLEVVDFCIKGTSRFSNVFSDYFRDEDAYADYLDNYLQFKDEKIAEVSSFAALKTFCNEEEVKAGIYMDGENPVMQRNIVMAKLFGPDEVLKNVVPKVTREEIEEYYQLEKQIAPYRQNGYCKSEEDQKKLLRFQRIKNRVEFQTITEFSEIINELLGQLISWSFLRERDLLYFQLGFHYLCLHNDTEKPAEYKEISREDGTVIRNAILHQVAAMYVGGLPVYTLADKKLAAFEKGEADCKLSISKDTAGAGKKIKDFFRYSKYVLIKDRMLTDQNQKYTIYLAGLELFENTDEHDNITDVRKYVDHFKYYATSDENAMSILDLYSEIHDRFFTYDMKYQKNVANMLENILLRHFVLIRPEFFTGSKKVGEGKKITCKARAQIEIAENGMRSEDFTYKLSDGKKNISTCMIAARDQKYLNTVARLLYYPHEAKKSIVDTREKKNNKKTNRGDGTFNKQKGTARKEKDNGPREFNDTGFSNTPFAGFDPFRNS

SEQ ID NO: 7 - protein, 1175 aa, Carnobacterium gallinarum DSM4847
MRITKVKIKLDNKLYQVTMQKEEKYGTLKLNEESRKSTAEILRLKKASFNKSFHSKTINSQKENKNATIKKNGDYISQIFEKLVGVDTNKNIRKPKMSLTDLKDLPKKDLALFIKRKFKNDDIVEIKNLDLISLFYNALQKVPGEHFTDESWADFCQEMMPYREYKNKFIERKIILLANSIEQNKGFSINPETFSKRKRVLHQWAIEVQERGDFSILDEKLSKLAEIYNFKKMCKRVQDELNDLEKSMKKGKNPEKEKEAYKKQKNFKIKTIWKDYPYKTHIGLIEKIKENEELNQFNIEIGKYFEHYFPIKKERCTEDEPYYLNSETIATTVNYQLKNALISYLMQIGKYKQFGLENQVLDSKKLQEIGIYEGFQTKFMDACVFATSSLKNIIEPMRSGDILGKREFKEAIATSSFVNYHHFFPYFPFELKGMKDRESELIPFGEQTEAKQMQNIWALRGSVQQIRNEIFHSFDKNQKFNLPQLDKSNFEFDASENSTGKSQSYIETDYKFLFEAEKNQLEQFFIERIKSSGALEYYPLKSLEKLFAKKEMKFSLGSQVVAFAPSYKKLVKKGHSYQTATEGTANYLGLSYYNRYELKEESFQAQYYLLKLIYQYVFLPNFSQGNSPAFRETVKAILRINKDEARKKMKKNKKFLRKYAFEQVREMEFKETPDQYMSYLQSEMREEKVRKAEKNDKGFEKNITMNFEKLLMQIFVKGFDVFLTTFAGKELLLSSEEKVIKETEISLSKKINEREKTLKASIQVEHQLVATNSAISYWLFCKLLDSRHLNELRNEMIKFKQSRIKFNHTQHAELIQNLLPIVELTILSNDYDEKNDSQNVDVSAYFEDKSLYETAPYVQTDDRTRVSFRPILKLEKYHTKSLIEALLKDNPQFRVAATDIQEWMHKREEIGELVEKRKNLHTEWAEGQQTLGAEKREEYRDYCKKIDRFNWKANKVTLTYLSQLHYLITDLLGRMVGFSALFERDLVYFSRSFSELGGETYHISDYKNLSGVLRLNAEVKPIKIKNIKVIDNEENPYKGNEPEVKPFLDRLHAYLENVIGIKAVHGKIRNQTAHLSVLQLELSMIESMNNLRDLMAYDRKLKNAVTKSMIKILDKHGMILKLKIDENHKNFEIESLIPKEIIHLKDKAIKTNQVSEEYCQLVLALLTTNPGNQLN

SEQ ID NO: 8 - protein, 1164 aa, Carnobacterium gallinarum DSM4847
MRMTKVKINGSPVSMNRSKLNGHLVWNGTTNTVNILTKKEQSFAASFLNKTLVKADQVKGYKVLAENIFIIFEQLEKSNSEKPSVYLNNIRRLKEAGLKRFFKSKYHEEIKYTSEKNQSVPTKLNLIPLFFNAVDRIQEDKFDEKNWSYFCKEMSPYLDYKKSYLNRKKEILANSIQQNRGFSMPTAEEPNLLSKRKQLFQQWAMKFQESPLIQQNNFAVEQFNKEFANKINELAAVYNVDELCTAITEKLMNFDKDKSNKTRNFEIKKLWKQHPHNKDKALIKLFNQEGNEALNQFNIELGKYFEHYFPKTGKKESAESYYLNPQTIIKTVGYQLRNAFVQYLLQVGKLHQYNKGVLDSQTLQEIGMYEGFQTKFMDACVFASSSLRNIIQATTNEDILTREKFKKELEKNVELKHDLFFKTEIVEERDENPAKKIAMTPNELDLWAIRGAVQRVRNQIFHQQINKRHEPNQLKVGSFENGDLGNVSYQKTIYQKLFDAEIKDIEIYFAEKIKSSGALEQYSMKDLEKLFSNKELTLSLGGQVVAFAPSYKKLYKQGYFYQNEKTIELEQFTDYDFSNDVFKANYYLIKLIYHYVFLPQFSQANNKLFKDTVHYVIQQNKELNTTEKDKKNNKKIRKYAFEQVKLMKNESPEKYMQYLQREMQEERTIKEAKKTNEEKPNYNFEKLLIQIFIKGFDTFLRNFDLNLNPAEELVGTVKEKAEGLRKRKERIAKILNVDEQIKTGDEEIAFWIFAKLLDARHLSELRNEMIKFKQSSVKKGLIKNGDLIEQMQPILELCILSNDSESMEKESFDKIEVFLEKVELAKNEPYMQEDKLTPVKFRFMKQLEKYQTRNFIENLVIENPEFKVSEKIVLNWHEEKEKIADLVDKRTKLHEEWASKAREIEEYNEKIKKNKSKKLDKPAEFAKFAEYKIICEAIENFNRLDHKVRLTYLKNLHYLMIDLMGRMVGFSVLFERDFVYMGRSYSALKKQSIYLNDYDTFANIRDWEVNENKHLFGTSSSDLTFQETAEFKNLKKPMENQLKALLGVTNHSFEIRNNIAHLHVLRNDGKGEGVSLLSCMNDLRKLMSYDRKLKNAVTKAIIKILDKHGMILKLTNNDHTKPFEIESLKPKKIIHLEKSNHSFPMDQVSQEYCDLVKKMLVFTN

SEQ ID NO: 9 - protein, 1154 aa, Paludibacter propionicigenes WB4
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 10 - protein, 970 aa, Listeria weihenstephanensis FSLR9-0317
MLALLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKVVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGDFKKNLPNSTTQSDVVKKMIPFFSDEIQNVNFDEAIWAIRGSIQQIRNEVYHCKKHSWKSILKIKGFEFEPNNMKYTDSDMQKLMDKDIAKIPDFIEEKLKSSGIIRFYSHDKLQSIWEMKQGFSLLTTNAPFVPSFKRVYAKGHDYQTSKNRYYDLGLTTFDILEYGEEDFRARYFLTKLVYYQQFMPWFTADNNAFRDAANFVLRLNKNRQQDAKAFINIREVEEGEMPRDYMGYVQGQIAIHEDSTEDTPNHFEKFISQVFIKGFDSHMRSADLKFIKNPRNQGLEQSEIEEMSFDIKVEPSFLKNKDDYIAFWTFCKMLDARHLSELRNEMIKYDGHLTGEQEIIGLALLGVDSRENDWKQFFSSEREYEKIMKGYVGEELYQREPYRQSDGKTPILFRGVEQARKYGTETVIQRLFDASPEFKVSKCNITEWERQKETIEETIERRKELHNEWEKNPKKPQNNAFFKEYKECCDAIDAYNWHKNKTTLVYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGEKKIDNGYIETNQVSEEYCGIVKRLLEI

SEQ ID NO: 11 - protein, 1051 aa, Listeriaceae bacterium FSLM6-0645
MKITKMRVDGRTIVMERTSKEGQLGYEGIDGNKTTEIIFDKKKESFYKSILNKTVRKPDEKEKNRRKQAINKAINKEITELMLAVLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKLVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGNFKKNLPNSTTRSDVVKKMIPFFSDELQNVNFDEAIWAIRGSIQQIRNEVYHCKKHSWKSILKIKGFEFEPNNMKYADSDMQKLMDKDIAKIPEFIEEKLKSSGVVRFYRHDELQSIWEMKQGFSLLTTNAPFVPSFKRVYAKGHDYQTSKNRYYNLDLTTFDILEYGEEDFRARYFLTKLVYYQQFMPWFTADNNAFRDAANFVLRLNKNRQQDAKAFINIREVEEGEMPRDYMGYVQGQIAIHEDSIEDTPNHFEKFISQVFIKGFDRHMRSANLKFIKNPRNQGLEQSEIEEMSFDIKVEPSFLKNKDDYIAFWIFCKMLDARHLSELRNEMIKYDGHLTGEQEIIGLALLGVDSRENDWKQFFSSEREYEKIMKGYVVEELYQREPYRQSDGKTPILFRGVEQARKYGTETVIQRLFDANPEFKVSKCNLAEWERQKETIEETIKRRKELHNEWAKNPKKPQNNAFFKEYKECCDAIDAYNWHKNKTTLAYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGGKKIDGGYIETNQVSEEYCGIVKRLLEM

SEQ ID NO: 12 - protein, 1152 aa, Leptotrichia wadei F0279
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 13 - protein, 1285 aa, Rhodobacter capsulatus SB1003
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRTSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 14 - protein, 1285 aa, Rhodobacter capsulatus R121
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 15 - protein, 1285 aa, Rhodobacter capsulatus DE442; identical to SEQ ID NO: 14

SEQ ID NO: 16 - protein, 1159 aa, Leptorichia buccalis
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 17 - protein, 1285 aa, Herbinix hemicellulosilytica
MKLTRRRISGNSVDQKITAAFYRDMSQGLLYYDSEDNDCTDKVIESMDFERSWRGRILKNGEDDKNPFYMFVKGLVGSNDKIVCEPIDVDSDPDNLDILINKNLTGFGRNLKAPDSNDTLENLIRKIQAGIPEEEVLPELKKIKEMIQKDIVNRKEQLLKSIKNNRIPFSLEGSKLVPSTKKMKWLFKLIDVPNKTFNEKMLEKYWEIYDYDKLKANITNRLDKTDKKARSISRAVSEELREYHKNLRTNYNRFVSGDRPAAGLDNGGSAKYNPDKEEFLLFLKEVEQYFKKYFPVKSKHSNKSKDKSLVDKYKNYCSYKVVKKEVNRSIINQLVAGLIQQGKLLYYFYYNDTWQEDFLNSYGLSYIQVEEAFKKSVMTSLSWGINRLTSFFIDDSNTVKFDDITTKKAKEAIESNYFNKLRTCSRMQDHFKEKLAFFYPVYVKDKKDRPDDDIENLIVLVKNAIESVSYLRNRTFHFKESSLLELLKELDDKNSGQNKIDYSVAAEFIKRDIENLYDVFREQIRSLGIAEYYKADMISDCFKTCGLEFALYSPKNSLMPAFKNVYKRGANLNKAYIRDKGPKETGDQGQNSYKALEEYRELTWYIEVKNNDQSYNAYKNLLQLIYYHAFLPEVRENEALITDFINRTKEWNRKETEERLNTKNNKKHKNFDENDDITVNTYRYESIPDYQGESLDDYLKVLQRKQMARAKEVNEKEEGNNNYIQFIRDVVVWAFGAYLENKLKNYKNELQPPLSKENIGLNDTLKELFPEEKVKSPFNIKCRFSISTFIDNKGKSTDNTSAEAVKTDGKEDEKDKKNIKRKDLLCFYLFLRLLDENEICKLQHQFIKYRCSLKERRFPGNRTKLEKETELLAELEELMELVRFTMPSIPEISAKAESGYDTMIKKYFKDFIEKKVFKNPKTSNLYYHSDSKTPVTRKYMALLMRSAPLHLYKDIFKGYYLITKKECLEYIKLSNIIKDYQNSLNELHEQLERIKLKSEKQNGKDSLYLDKKDFYKVKEYVENLEQVARYKHLQHKINFESLYRIFRIHVDIAARMVGYTQDWERDMHFLFKALVYNGVLEERRFEAIFNNNDDNNDGRIVKKIQNNLNNKNRELVSMLCWNKKLNKNEFGAIIWKRNPIAHLNHFTQTEQNSKSSLESLINSLRILLAYDRKRQNAVTKTINDLLLNDYHIRIKWEGRVDEGQIYFNIKEKEDIENEPIIHLKHLHKKDCYIYKNSYMFDKQKEWICNGIKEEVYDKSILKCIGNLFKFDYEDKNKSSANPKHT

SEQ ID NO: 18 - protein, 1344 aa, Eubacterium rectale
MLRRDKEVKKLYNVFNQIQVGTKPKKWNNDEKLSPEENERRAQQKNIKMKNYKWREACSKYVESSQRIINDVIFYSYRKAKNKLRYMRKNEDILKKMQEAEKLSKFSGGKLEDFVAYTLRKSLVVSKYDTQEFDSLAAMVVFLECIGKNNISDHEREIVCKLLELIRKDFSKLDPNVKGSQGANIVRSVRNQNMIVQPQGDRFLFPQVYAKENETVTNKNVEKEGLNEFLLNYANLDDEKRAESLRKLRRILDVYFSAPNHYEKDMDITLSDNIEKEKFNVWEKHECGKKETGLFVDIPDVLMEAEAENIKLDAVVEKRERKVLNDRVRKQNIICYRYTRAVVEKYNSNEPLFFENNAINQYWIHHIENAVERILKNCKAGKLFKLRKGYLAEKVWKDAINLISIKYIALGKAVYNFALDDIWKDKKNKELGIVDERIRNGITSFDYEMIKAHENLQRELAVDIAFSVNNLARAVCDMSNLGNKESDFLLWKRNDIADKLKNKDDMASVSAVLQFFGGKSSWDINIFKDAYKGKKKYNYEVRFIDDLRKAIYCARNENFHFKTALVNDEKWNTELFGKIFERETEFCLNVEKDRFYSNNLYMFYQVSELRNMLDHLYSRSVSRAAQVPSYNSVIVRTAFPEYITNVLGYQKPSYDADTLGKWYSACYYLLKEIYYNSFLQSDRALQLFEKSVKTLSWDDKKQQRAVDNFKDHFSDIKSACTSLAQVCQIYMTEYNQQNNQIKKVRSSNDSIFDQPVYQHYKVLLKKAIANAFADYLKNNKDLFGFIGKPFKANEIREIDKEQFLPDWTSRKYEALCIEVSGSQELQKWYIVGKFLNARSLNLMVGSMRSYIQYVTDIKRRAASIGNELHVSVHDVEKVEKWVQVIEVCSLLASRTSNQFEDYFNDKDDYARYLKSYVDFSNVDMPSEYSALVDFSNEEQSDLYVDPKNPKVNRNIVHSKLFAADHILRDIVEPVSKDNIEEFYSQKAEIAYCKIKGKEITAEEQKAVLKYQKLKNRVELRDIVEYGEIINELLGQLINWSFMRERDLLYFQLGFHYDCLRNDSKKPEGYKNIKVDENSIKDAILYQIIGMYVNGVTVYAPEKDGDKLKEQCVKGGVGVKVSAFHRYSKYLGLNEKTLYNAGLEIFEVVAEHEDIINLRNGIDHFKYYLGDYRSMLSIYSEVFDRFFTYDIKYQKNVLNLLQNILLRHNVIVEPILESGFKTIGEQTKPGAKLSIRSIKSDTFQYKVKGGTLITDAKDERYLETIRKILYYAENEEDNLKKSVVVTNADKYEKNKESDDQNKQKEKKNKDNKGKKNEETKSDAEKNNNERLSYNPFANLNFKLSN

SEQ ID NO: 19 - protein, 1373 aa, Eubacteriaceae bacterium
MKISKESHKRTAVAVMEDRVGGVVYVPGGSGIDLSNNLKKRSMDTKSLYNVFNQIQAGTAPSEYEWKDYLSEAENKKREAQKMIQKANYELRRECEDYAKKANLAVSRIIFSKKPKKIFSDDDIISHMKKQRLSKFKGRMEDFVLIALRKSLVVSTYNQEVFDSRKAATVFLKNIGKKNISADDERQIKQLMALIREDYDKWNPDKDSSDKKESSGTKVIRSIEHQNMVIQPEKNKLSLSKISNVGKKTKTKQKEKAGLDAFLKEYAQIDENSRMEYLKKLRRLLDTYFAAPSSYIKGAAVSLPENINFSSELNVWERHEAAKKVNINFVEIPESLLNAEQNNNKINKVEQEHSLEQLRTDIRRRNITCYHFANALAADERYHTLFFENMAMNQFWIHHMENAVERILKKCNVGTLFKLRIGYLSEKVWKDMLNLLSIKYIALGKAVYHFALDDIWKADIWKDASDKNSGKINDLTLKGISSFDYEMVKAQEDLQREMAVGVAFSTNNLARVTCKMDDLSDAESDFLLWNKEAIRRHVKYTEKGEILSAILQFFGGRSLWDESLFEKAYSDSNYELKFLDDLKRAIYAARNETFHFKTAAIDGGSWNTRLFGSLFEKEAGLCLNVEKNKFYSNNLVLFYKQEDLRVFLDKLYGKECSRAAQIPSYNTILPRKSFSDFMKQLLGLKEPVYGSAILDQWYSACYYLFKEVYYNLFLQDSSAKALFEKAVKALKGADKKQEKAVESFRKRYWEISKNASLAEICQSYITEYNQQNNKERKVRSANDGMFNEPIYQHYKMLLKEALKMAFASYIKNDKELKFVYKPTEKLFEVSQDNFLPNWNSEKYNTLISEVKNSPDLQKWYIVGKFMNARMLNLLLGSMRSYLQYVSDIQKRAAGLGENQLHLSAENVGQVKKWIQVLEVCLLLSVRISDKFTDYFKDEEEYASYLKEYVDFEDSAMPSDYSALLAFSNEGKIDLYVDASNPKVNRNIIQAKLYAPDMVLKKVVKKISQDECKEFNEKKEQIMQFKNKGDEVSWEEQQKILEYQKLKNRVELRDLSEYGELINELLGQLINWSYLRERDLLYFQLGFHYSCLMNESKKPDAYKTIRRGTVSIENAVLYQIIAMYINGFPVYAPEKGELKPQCKTGSAGQKIRAFCQWASMVEKKKYELYNAGLELFEVVKEHDNIIDLRNKIDHFKYYQGNDSILALYGEIFDRFFTYDMKYRNNVLNHLQNILLRHNVIIKPIISKDKKEVGRGKMKDRAAFLLEEVSSDRFTYKVKEGERKIDAKNRLYLETVRDILYFPNRAVNDKGEDVIICSKKAQDLNEKKADRDKNHDKSKDTNQKKEGKNQEEKSENKEPYSDRMTWKPFAGIKLE

SEQ ID NO: 20 - protein, 1334 aa, Lachnospiraceae bacterium
MKISKVDHTRMAVAKGNQHRRDEISGILYKDPTKTGSIDFDERFKKLNCSAKILYHVFNGIAEGSNKYKNIVDKVNNNLDRVLFTGKSYDRKSIIDIDTVLRNVEKINAFDRISTEEREQIIDDLLEIQLRKGLRKGKAGLREVLLIGAGVIVRTDKKQEIADFLEILDEDFNKTNQAKNIKLSIENQGLVVSPVSRGEERIFDVSGAQKGKSSKKAQEKEALSAFLLDYADLDKNVRFEYLRKIRRLINLYFYVKNDDVMSLTEIPAEVNLEKDFDIWRDHEQRKEENGDFVGCPDILLADRDVKKSNSKQVKIAERQLRESIREKNIKRYRFSIKTIEKDDGTYFFANKQISVFWIHRIENAVERILGSINDKKLYRLRLGYLGEKVWKDILNFLSIKYIAVGKAVFNFAMDDLQEKDRDIEPGKISENAVNGLTSFDYEQIKADEMLQREVAVNVAFAANNLARVTVDIPQNGEKEDILLWNKSDIKKYKKNSKKGILKSILQFFGGASTWNMKMFEIAYHDQPGDYEENYLYDIIQIIYSLRNKSFHFKTYDHGDKNWNRELIGKMIEHDAERVISVEREKFHSNNLPMFYKDADLKKILDLLYSDYAGRASQVPAFNTVLVRKNFPEFLRKDMGYKVHFNNPEVENQWHSAVYYLYKEIYYNLFLRDKEVKNLFYTSLKNIRSEVSDKKQKLASDDFASRCEEIEDRSLPEICQIIMTEYNAQNFGNRKVKSQRVIEKNKDIFRHYKMLLIKTLAGAFSLYLKQERFAFIGKATPIPYETTDVKNFLPEWKSGMYASFVEEIKNNLDLQEWYIVGRFLNGRMLNQLAGSLRSYIQYAEDIERRAAENRNKLFSKPDEKIEACKKAVRVLDLCIKISTRISAEFTDYFDSEDDYADYLEKYLKYQDDAIKELSGSSYAALDHFCNKDDLKFDIYVNAGQKPILQRNIVMAKLFGPDNILSEVMEKVTESAIREYYDYLKKVSGYRVRGKCSTEKEQEDLLKFQRLKNAVEFRDVTEYAEVINELLGQLISWSYLRERDLLYFQLGFHYMCLKNKSFKPAEYVDIRRNNGTIIHNAILYQIVSMYINGLDFYSCDKEGKTLKPIETGKGVGSKIGQFIKYSQYLYNDPSYKLEIYNAGLEVFENIDEHDNITDLRKYVDHFKYYAYGNKMSLLDLYSEFFDRFFTYDMKYQKNVVNVLENILLRHFVIFYPKFGSGKKDVGIRDCKKERAQIEISEQSLTSEDFMFKLDDKAGEEAKKFPARDERYLQTIAKLLYYPNEIEDMNRFMKKGETINKKVQFNRKKKITRKQKNNSSNEVLSSTMGYLFKNIKL

SEQ ID NO: 21 - protein, 500 aa, Chloroflexus aggregans
MTDQVRREEVAAGELADTPLAAAQTPAADAAVAATPAPAEAVAPTPEQAVDQPATTGESEAPVTTAQAAAHEAEPAEATGASFTPVSEQQPQKPRRLKDLQPGMELEGKVTSIALYGIFVDVGVGRDGLVHISEMSDRRIDTPSELVQIGDTVKVWVKSVDLDARRISLTMLNPSRGEKPRRSRQSQPAQPQPRRQEVDREKLASLKVGEIVEGVITGFAPFGAFADIGVGKDGLIHISELSEGRVEKPEDAVKVGERYQFKVLEIDGEGTRISLSLRRAQRTQRMQQLEPGQIIEGTVSGIATFGAFVDIGVGRDGLVHISALAPHRVAKVEDVVKVGDKVKVKVLGVDPQSKRISLTMRLEEEQPATTAGDEAAEPAEEVTPTRRGNLERFAAAAQTARERSERGERSERGERRERRERRPAQSSPDTYIVGEDDDESFEGNATIEDLLTKFGGSSSRRDRDRRRRHEDDDDEEMERPSNRRQREAIRRTLQQIGYDE

SEQ ID NO: 22 - protein, 249 aa, Demequina aurantiaca
MDLTWHALLILFIVALLAGFLDTLAGGGGLLTVPALLLTGIPPLQALGTNKLQSSFGTGMATYQVIRKKRVHWRDVRWPMVWAFLGSAAGAVAVQFIDTDALLIIIPVVLALVAAYFLFVPKSHLPPPEPRMSDPAYEATLVPIIGAYDGAFGPGTGSLYALSGVALRAKTLVQSTAIAKTLNFATNFAALLVFAFAGHMLWTVGAVMIAGQLIGAYAGSHMLFRVNPLVLRVLIVVMSLGMLIRVLLD

SEQ ID NO: 23 - protein, 1235 aa, Thalassospira sp.
MRIIKPYGRSHVEGVATQEPRRKLRLNSSPDISRDIPGFAQSHDALIIAQWISAIDKIATKPKPDKKPTQAQINLRTTLGDAAWQHVMAENLLPAATDPAIREKLHLIWQSKIAPWGTARPQAEKDGKPTPKGGWYERFCGVLSPEAITQNVARQIAKDIYDHLHVAAKRKGREPAKQGESSNKPGKFKPDRKRGLIEERAESIAKNALRPGSHAPCPWGPDDQATYEQAGDVAGQIYAAARDCLEEKKRRSGNRNTSSVQYLPRDLAAKILYAQYGRVFGPDTTIKAALDEQPSLFALHKAIKDCYHRLINDARKRDILRILPRNMAALFRLVRAQYDNRDINALIRLGKVIHYHASEQGKSEHHGIRDYWPSQQDIQNSRFWGSDGQADIKRHEAFSRIWRHIIALASRTLHDWADPHSQKFSGENDDILLLAKDAIEDDVFKAGHYERKCDVLFGAQASLFCGAEDFEKAILKQAITGTGNLRNATFHFKGKVRFEKELQELTKDVPVEVQSAIAALWQKDAEGRTRQIAETLQAVLAGHFLTEEQNRHIFAALTAAMAQPGDVPLPRLRRVLARHDSICQRGRILPLSPCPDRAKLEESPALTCQYTVLKMLYDGPFRAWLAQQNSTILNHYIDSTIARTDKAARDMNGRKLAQAEKDLITSRAADLPRLSVDEKMGDFLARLTAATATEMRVQRGYQSDGENAQKQAAFIGQFECDVIGRAFADFLNQSGFDFVLKLKADTPQPDAAQCDVTALIAPDDISVSPPQAWQQVLYFILHLVPVDDASHLLHQIRKWQVLEGKEKPAQIAHDVQSVLMLYLDMHDAKFTGGAALHGIEKFAEFFAHAADFRAVFPPQSLQDQDRSIPRRGLREIVRFGHLPLLQHMSGTVQITHDNVVAWQAARTAGATGMSPIARRQKQREELHALAVERTARFRNADLQNYMHALVDVIKHRQLSAQVTLSDQVRLHRLMMGVLGRLVDYAGLWERDLYFVVLALLYHHGATPDDVFKGQGKKNLADGQVVAALKPKNRKAAAPVGVFDDLDHYGIYQDDRQSIRNGLSHFNMLRGGKAPDLSHWVNQTRSLVAHDRKLKNAVAKSVIEMLAREGFDLDWGIQTDRGQHILSHGKIRTRQAQHFQKSRLHIVKKSAKPDKNDTVKIRENLHGDAMVERVVQLFAAQVQKRYDITVEKRLDHLFLKPQDQKGKNGIHTHNGWSKTEKKRRPSRENRKGNHEN

SEQ ID NO: 24 - protein, 1312 aa, Pseudobutyrivibrio sp.
MKFSKESHRKTAVGVTESNGIIGLLYKDPLNEKEKIEDVVNQRANSTKRLFNLFGTEATSKDISRASKDLAKVVNKAIGNLKGNKKFNKKEQITKGLNTKIIVEELKNVLKDEKKLIVNKDIIDEACSRLLKTSFRTAKTKQAVKMILTAVLIENTNLSKEDEAFVHEYFVKKLVNEYNKTSVKKQIPVALSNQNMVIQPNSVNGTLEISETKKSKETKTTEKDAFRAFLRDYATLDENRRHKMRLCLRNLVNLYFYGETSVSKDDFDEWRDHEDKKQNDELFVKKIVSIKTDRKGNVKEVLDVDATIDAIRTNNIACYRRALAYANENPDVFFSDTMLNKFWIHHVENEVERIYGHINNNTGDYKYQLGYLSEKVWKGIINYLSIKYIAEGKAVYNYAMNALAKDNNSNAFGKLDEKFVNGITSFEYERIKAEETLQRECAVNIAFAANHLANATVDLNEKDSDFLLLKHEDNKDTLGAVARPNILRNILQFFGGKSRWNDFDFSGIDEIQLLDDLRKMIYSLRNSSFHFKTENIDNDSWNTKLIGDMFAYDFNMAGNVQKDKMYSNNVPMFYSTSDIEKMLDRLYAEVHERASQVPSFNSVFVRKNFPDYLKNDLKITSAFGVDDALKWQSAVYYVCKEIYYNDFLQNPETFTMLKDYVQCLPIDIDKSMDQKLKSERNAHKNFKEAFATYCKECDSLSAICQMIMTEYNNQNKGNRKVISARTKDGDKLIYKHYKMILFEALKNVFTIYLEKNINTYGFLKKPKLINNVPAIEEFLPNYNGRQYETLVNRITEETELQKWYIVGRLLNPKQVNQLIGNFRSYVQYVNDVARRAKQTGNNLSNDNIAWDVKNIIQIFDVCTKLNGVTSNILEDYFDDGDDYARYLKNFVDYTNKNNDHSATLLGDFCAKEIDGIKIGIYHDGTNPIVNRNIIQCKLYGATGIISDLTKDGSILSVDYEIIKKYMQMQKEIKVYQQKGICKTKEEQQNLKKYQELKNIVELRNIIDYSEILDELQGQLINWGYLRERDLMYFQLGFHYLCLHNESKKPVGYNNAGDISGAVLYQIVAMYTNGLSLIDANGKSKKNAKASAGAKVGSFCSYSKEIRGVDKDTKEDDDPIYLAGVELFENINEHQQCINLRNYIEHFHYYAKHDRSMLDLYSEVFDRFFTYDMKYTKNVPNMMYNILLQHLVVPAFEFGSSEKRLDDNDEQTKPRAMFTLREKNGLSSEQFTYRLGDGNSTVKLSARGDDYLRAVASLLYYPDRAPEGLIRDAEAEDKFAKINHSNPKSDNRNNRGNFKNPKVQWYNNKTKRK

SEQ ID NO: 25 - protein, 1343 aa, Butyrivibrio sp.
MKISKVDHRKTAVKITDNKGAEGFIYQDPTRDSSTMEQIISNRARSSKVLFNIFGDTKKSKDLNKYTESLIIYVNKAIKSLKGDKRNNKYEEITESLKTERVLNALIQAGNEFTCSENNIEDALNKYLKKSFRVGNTKSALKKLLMAAYCGYKLSIEEKEEIQNYFVDKLVKEYNKDTVLKYTAKSLKHQNMVVQPDTDNHVFLPSRIAGATQNKMSEKEALTEFLKAYAVLDEEKRHNLRIILRKLVNLYFYESPDFIYPENNEWKEHDDRKNKTETFVSPVKVNEEKNGKTFVKIDVPATKDLIRLKNIECYRRSVAETAGNPITYFTDHNISKFWIHHIENEVEKIFALLKSNWKDYQFSVGYISEKVWKEIINYLSIKYIAIGKAVYNYALEDIKKNDGTLNFGVIDPSFYDGINSFEYEKIKAEETFQREVAVYVSFAVNHLSSATVKLSEAQSDMLVLNKNDIEKIAYGNTKRNILQFFGGQSKWKEFDFDRYINPVNYTDIDFLFDIKKMVYSLRNESFHFTTTDTESDWNKNLISAMFEYECRRISTVQKNKFFSNNLPLFYGENSLERVLHKLYDDYVDRMSQVPSFGNVFVRKKFPDYMKEIGIKHNLSSEDNLKLQGALYFLYKEIYYNAFISSEKAMKIFVDLVNKLDTNARDDKGRITHEAMAHKNFKDAISHYMTHDCSLADICQKIMTEYNQQNTGHRKKQTTYSSEKNPEIFRHYKMILFMLLQKAMTEYISSEEIFDFIMKPNSPKTDIKEEEFLPQYKSCAYDNLIKLIADNVELQKWYITARLLSPREVNQLIGSFRSYKQFVSDIERRAKETNNSLSKSGMTVDVENITKVLDLCTKLNGRFSNELTDYFDSKDDYAVYVSKFLDFGFKIDEKFPAALLGEFCNKEENGKKIGIYHNGTEPILNSNIIKSKLYGITDVVSRAVKPVSEKLIREYLQQEVKIKPYLENGVCKNKEEQAALRKYQELKNRIEFRDIVEYSEIINELMGQLINFSYLRERDLMYFQLGFHYLCLNNYGAKPEGYYSIVNDKRTIKGAILYQIVAMYTYGLPIYHYVDGTISDRRKNKKTVLDTLNSSETVGAKIKYFIYYSDELFNDSLILYNAGLELFENINEHENIVNLRKYIDHFKYYVSQDRSLLDIYSEVFDRYFTYDRKYKKNVMNLFSNIMLKHFIITDFEFSTGEKTIGEKNTAKKECAKVRIKRGGLSSDKFTYKFKDAKPIELSAKNTEFLDGVARILYYPENVVLTDLVRNSEVEDEKRIEKYDRNHNSSPTRKDKTYKQDVKKNYNKKTSKAFDSSKLDTKSVGNNLSDNPVLKQFLSESKKKR

SEQ ID NO: 26 - protein, 1276 aa, Blautia sp.
MKISKVDHVKSGIDQKLSSQRGMLYKQPQKKYEGKQLEEHVRNLSRKAKALYQVFPVSGNSKMEKELQIINSFIKNILLRLDSGKTSEEIVGYINTYSVASQISGDHIQELVDQHLKESLRKYTCVGDKRIYVPDIIVALLKSKFNSETLQYDNSELKILIDFIREDYLKEKQIKQIVHSIENNSTPLRIAEINGQKRLIPANVDNPKKSYIFEFLKEYAQSDPKGQESLLQHMRYLILLYLYGPDKITDDYCEEIEAWNFGSIVMDNEQLFSEEASMLIQDRIYVNQQIEEGRQSKDTAKVKKNKSKYRMLGDKIEHSINESVVKHYQEACKAVEEKDIPWIKYISDHVMSVYSSKNRVDLDKLSLPYLAKNTWNTWISFIAMKYVDMGKGVYHFAMSDVDKVGKQDNLIIGQIDPKFSDGISSFDYERIKAEDDLHRSMSGYIAFAVNNFARAICSDEFRKKNRKEDVLTVGLDEIPLYDNVKRKLLQYFGGASNWDDSIIDIIDDKDLVACIKENLYVARNVNFHFAGSEKVQKKQDDILEEIVRKETRDIGKHYRKVFYSNNVAVFYCDEDIIKLMNHLYQREKPYQAQIPSYNKVISKTYLPDLIFMLLKGKNRTKISDPSIMNMFRGTFYFLLKEIYYNDFLQASNLKEMFCEGLKNNVKNKKSEKPYQNFMRRFEELENMGMDFGEICQQIMTDYEQQNKQKKKTATAVMSEKDKKIRTLDNDTQKYKHFRTLLYIGLREAFIIYLKDEKNKEWYEFLREPVKREQPEEKEFVNKWKLNQYSDCSELILKDSLAAAWYVVAHFINQAQLNHLIGDIKNYIQFISDIDRRAKSTGNPVSESTEIQIERYRKILRVLEFAKFFCGQITNVLTDYYQDENDFSTHVGHYVKFEKKNMEPAHALQAFSNSLYACGKEKKKAGFYYDGMNPIVNRNITLASMYGNKKLLENAMNPVTEQDIRKYYSLMAELDSVLKNGAVCKSEDEQKNLRHFQNLKNRIELVDVLTLSELVNDLVAQLIGWVYIRERDMMYLQLGLHYIKLYFTDSVAEDSYLRTLDLEEGSIADGAVLYQIASLYSFNLPMYVKPNKSSVYCKKHVNSVATKFDIFEKEYCNGDETVIENGLRLFENINLHKDMVKFRDYLAHFKYFAKLDESILELYSKAYDFFFSYNIKLKKSVSYVLTNVLLSYFINAKLSFSTYKSSGNKTVQHRTTKISVVAQTDYFTYKLRSIVKNKNGVESIENDDRRCEVVNIAARDKEFVDEVCNVINYNSDK

SEQ ID NO: 27 - protein, 1168 aa, Leptotrichia sp.
MKITKIDGISHKKYIKEGKLVKSTSEENKTDERLSELLTIRLDTYIKNPDNASEEENRIRRENLKEFFSNKVLYLKDGILYLKDRREKNQLQNKNYSEEDISEYDLKNKNNFLVLKKILLNEDINSEELEIFRNDFEKKLDKINSLKYSLEENKANYQKINENNIKKVEGKSKRNIFYNYYKDSAKRNDYINNIQEAFDKLYKKEDIENLFFLIENSKKHEKYKIRECYHKIIGRKNDKENFATIIYEEIQNVNNMKELIEKVPNVSELKKSQVFYKYYLNKEKLNDENIKYVFCHFVEIEMSKLLKNYVYKKPSNISNDKVKRIFEYQSLKKLIENKLLNKLDTYVRNCGKYSFYLQDGEIATSDFIVGNRQNEAFLRNIIGVSSTAYFSLRNILETENENDITGRMRGKTVKNNKGEEKYISGEIDKLYDNNKQNEVKKNLKMFYSYDFNMNSKKEIEDFFSNIDEAISSIRHGIVHFNLELEGKDIFTFKNIVPSQISKKMFHDEINEKKLKLKIFKQLNSANVFRYLEKYKILNYLNRTRFEFVNKNIPFVPSFTKLYSRIDDLKNSLGIYWKTPKTNDDNKTKEITDAQIYLLKNIYYGEFLNYFMSNNGNFFEITKEIIELNKNDKRNLKTGFYKLQKFENLQEKTPKEYLANIQSLYMINAGNQDEEEKDTYIDFIQKIFLKGFMTYLANNGRLSLIYIGSDEETNTSLAEKKQEFDKFLKKYEQNNNIEIPYEINEFVREIKLGKILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKISDEAKYKISIEELKNYSKKKNEIEENHTTQENLHRKYARPRKDEKFTDEDYKKYEKAIRNIQQYTHLKNKVEFNELNLLQSLLLRILHRLVGYTSIWERDLRFRLKGEFPENQYIEEIFNFDNSKNVKYKNGQIVEKYINFYKELYKDDTEKISIYSDKKVKELKKEKKDLYIRNYIAHFNYIPNAEISLLEMLENLRKLLSYDRKLKNAIMKSIVDILKEYGFVVTFKIEKDKKIRIESLKSEEVVHLKKLKLKDNDKKKEPIKTYRNSKELCKLVKVMFEYKMKEKKSEN

SEQ ID NO: 28 - protein, 1138 aa, Bacteroides ihuae
MRITKVKVKESSDQKDKMVLIHRKVGEGTLVLDENLADLTAPIIDKYKDKSFELSLLKQTLVSEKEMNIPKCDKCTAKERCLSCKQREKRLKEVRGAIEKTIGAVIAGRDIIPRLNIFNEDEICWLIKPKLRNEFTFKDVNKQVVKLNLPKVLVEYSKKNDPTLFLAYQQWIAAYLKNKKGHIKKSILNNRVVIDYSDESKLSKRKQALELWGEEYETNQRIALESYHTSYNIGELVTLLPNPEEYVSDKGEIRPAFHYKLKNVLQMHQSTVFGTNEILCINPIFNENRANIQLSAYNLEVVKYFEHYFPIKKKKKNLSLNQAIYYLKVETLKERLSLQLENALRMNLLQKGKIKKHEFDKNTCSNTLSQIKRDEFFVLNLVEMCAFAANNIRNIVDKEQVNEILSKKDLCNSLSKNTIDKELCTKFYGADFSQIPVAIWAMRGSVQQIRNEIVHYKAEAIDKIFALKTFEYDDMEKDYSDTPFKQYLELSIEKIDSFFIEQLSSNDVLNYYCTEDVNKLLNKCKLSLRRTSIPFAPGFKTIYELGCHLQDSSNTYRIGHYLMLIGGRVANSTVTKASKAYPAYRFMLKLIYNHLFLNKFLDNHNKRFFMKAVAFVLKDNRENARNKFQYAFKEIRMMNNDESIASYMSYIHSLSVQEQEKKGDKNDKVRYNTEKFIEKVFVKGFDDFLSWLGVEFILSPNQEERDKTVTREEYENLMIKDRVEHSINSNQESHIAFFTFCKLLDANHLSDLRNEWIKFRSSGDKEGFSYNFAIDIIELCLLTVDRVEQRRDGYKEQTELKEYLSFFIKGNESENTVWKGFYFQQDNYTPVLYSPIELIRKYGTLELLKLIIVDEDKITQGEFEEWQTLKKVVEDKVTRRNELHQEWEDMKNKSSFSQEKCSIYQKLCRDIDRYNWLDNKLHLVHLRKLHNLVIQILSRMARFIALWDRDFVLLDASRANDDYKLLSFFNFRDFINAKKTKTDDELLAEFGSKIEKKNAPFIKAEDVPLMVECIEAKRSFYQKVFFRNNLQVLADRNFIAHYNYISKTAKCSLFEMIIKLRTLMYYDRKLRNAVVKSIANVFDQNGMVLQLSLDDSHELKVDKVISKRIVHLKNNNIMTDQVPEEYYKICRRLLEMKK

SEQ ID NO: 29 - protein, 697 aa, Porphyromonadaceae bacterium
MEFRDSIFKSLLQKEIEKAPLCFAEKLISGGVFSYYPSERLKEFVGNHPFSLFRKTMPFSPGFKRVMKSGGNYQNANRDGRFYDLDIGVYLPKDGFGDEEWNARYFLMKLIYNQLFLPYFADAENHLFRECVDFVKRVNRDYNCKNNNSEEQAFIDIRSMREDESIADYLAFIQSNIIIEENKKKETNKEGQINFNKFLLQVFVKGFDSFLKDRTELNFLQLPELQGDGTRGDDLESLDKLGAVVAVDLKLDATGIDADLNENISFYTFCKLLDSNHLSRLRNEIIKYQSANSDFSHNEDFDYDRIISIIELCMLSADHVSTNDNESIFPNNDKDFSGIRPYLSTDAKVETFEDLYVHSDAKTPITNATMVLNWKYGTDKLFERLMISDQDFLVTEKDYFVWKELKKDIEEKIKLREELHSLWVNTPKGKKGAKKKNGRETTGEFSEENKKEYLEVCREIDRYVNLDNKLHFVHLKRMHSLLIELLGRFVGFTYLFERDYQYYHLEIRSRRNKDAGVVDKLEYNKIKDQNKYDKDDFFACTFLYEKANKVRNFIAHFNYLTMWNSPQEEEHNSNLSGAKNSSGRQNLKCSLTELINELREVMSYDRKLKNAVTKAVIDLFDKHGMVIKFRIVNNNNNDNKNKHHLELDDIVPKKIMHLRGIKLKRQDGKPIPIQTDSVDPLYCRMWKKLLDLKPTPF

SEQ ID NO: 30 - protein, 204 aa, Listeria riparia
MHDAWAENPKKPQSDAFLKEYKACCEAIDTYNWHKNKATLVYVNELHHLLIDILGRLVGYVAIADRDFQCMANQYLKSSGHTERVDSWINTIRKNRPDYIEKLDIFMNKAGLFVSEKNGRNYIAHLNYLSPKHKYSLLYLFEKLREMLKYDRKLKNAVTKSLIDLLDKHGMCVVFANLKNNKHRLVIASLKPKKIETFKWKKIK

SEQ ID NO: 31 - protein, 1082 aa, Insolitispirillum peregrinum
MRIIRPYGSSTVASPSPQDAQPLRSLQRQNGTFDVAEFSRRHPELVLAQWVAMLDKIIRKPAPGKNSTALPRPTAEQRRLRQQVGAALWAEMQRHTPVPPELKAVWDSKVHPYSKDNAPATAKTPSHRGRWYDRFGDPETSAATVAEGVRRHLLDSAQPFRANGGQPKGKGVIEHRALTIQNGTLLHHHQSEKAGPLPEDWSTYRADELVSTIGKDARWIKVAASLYQHYGRIFGPTTPISEAQTRPEFVLHTAVKAYYRRLFKERKLPAERLERLLPRTGEALRHAVTVQHGNRSLADAVRIGKILHYGWLQNGEPDPWPDDAALYSSRYWGSDGQTDIKHSEAVSRVWRRALTAAQRTLTSWLYPAGTDAGDILLIGQKPDSIDRNRLPLLYGDSTRHWTRSPGDVWLFLKQTLENLRNSSFHFKTLSAFTSHLDGTCESEPAEQQAAQALWQDDRQQDHQQVFLSLRALDATTYLPTGPLHRIVNAVQSTDATLPLPRFRRVVTRAANTRLKGFPVEPVNRRTMEDDPLLRCRYGVLKLLYERGFRAWLETRPSIASCLDQSLKRSTKAAQTINGKNSPQGVEILSRATKLLQAEGGGGHGIHDLFDRLYAATAREMRVQVGYHHDAEAARQQAEFIEDLKCEVVARAFCAYLKTLGIQGDTFRRQPEPLPTWPDLPDLPSSTIGTAQAALYSVLHLMPVEDVGSLLHQLRRWLVALQARGGEDGTAITATIPLLELYLNRHDAKFSGGGAGTGLRWDDWQVFFDCQATFDRVFPPGPALDSHRLPLRGLREVLRFGRVNDLAALIGQDKITAAEVDRWHTAEQTIAAQQQRREALHEQLSRKKGTDAEVDEYRALVTAIADHRHLTAHVTLSNVVRLHRLMTTVLGRLVDYGGLWERDLTFVTLYEAHRLGGLRNLLSESRVNKFLDGQTPAALSKKNNAEENGMISKVLGDKARRQIRNDFAHFNMLQQGKKTINLTDEINNARKLMAHDRKLKNAITRSVTTLLQQDGLDIVWTMDASHRLTDAKIDSRNAIHLHKTHNRANIREPLHGKSYCRWVAALFGATSTPSATKKSDKIR

SEQ ID NO: 32 - protein, 1001 aa, Artificial Sequence
  Synthetic
  misc_feature (7)..(9): Xaa can be any naturally occurring amino acid
  misc_feature (11)..(11): Xaa can be any naturally occurring amino acid
  misc_feature (14)..(16): Xaa can be any naturally occurring amino acid
  misc_feature (20)..(20): Xaa can be any naturally occurring amino acid
  misc_feature (22)..(22): Xaa can be any naturally occurring amino acid
  misc_feature (29)..(29): Xaa can be any naturally occurring amino acid
  misc_feature (36)..(36): Xaa can be any naturally occurring amino acid
  misc_feature (42)..(43): Xaa can be any naturally occurring amino acid
  misc_feature (48)..(48): Xaa can be any naturally occurring amino acid
  misc_feature (52)..(53): Xaa can be any naturally occurring amino acid
  misc_feature (57)..(57): Xaa can be any naturally occurring amino acid
  misc_feature (59)..(59): Xaa can be any naturally occurring amino acid
  misc_feature (69)..(71): Xaa can be any naturally occurring amino acid
  misc_feature (73)..(73): Xaa can be any naturally occurring amino acid
  misc_feature (75)..(75): Xaa can be any naturally occurring amino acid
  misc_feature (78)..(79): Xaa can be any naturally occurring amino acid
  misc_feature (86)..(86): Xaa can be any naturally occurring amino acid
  misc_feature (89)..(89): Xaa can be any naturally occurring amino acid
  MISC_FEATURE (90)..(90): Xaa represents Leucine or Isoleucine
  misc_feature (101)..(101): Xaa can be any naturally occurring amino acid
  misc_feature (104)..(104): Xaa can be any naturally occurring amino acid
  misc_feature (111)..(111): Xaa can be any naturally occurring amino acid
  misc_feature (116)..(116): Xaa can be any naturally occurring amino acid
  misc_feature (121)..(121): Xaa can be any naturally occurring amino acid
  misc_feature (128)..(130): Xaa can be any naturally occurring amino acid
  misc_feature (133)..(133): Xaa can be any naturally occurring amino acid
  misc_feature (145)..(145): Xaa can be any naturally occurring amino acid
  misc_feature (148)..(148): Xaa can be any naturally occurring amino acid
  misc_feature (167)..(167): Xaa can be any naturally occurring amino acid
  misc_feature (174)..(174): Xaa can be any naturally occurring amino acid
  misc_feature (192)..(192): Xaa can be any naturally occurring amino acid
  misc_feature (194)..(195): Xaa can be any naturally occurring amino acid
  misc_feature (199)..(199): Xaa can be any naturally occurring amino acid
  misc_feature (202)..(203): Xaa can be any naturally occurring amino acid
  misc_feature (206)..(206): Xaa can be any naturally occurring amino acid
  misc_feature (217)..(219): Xaa can be any naturally occurring amino acid
  misc_feature (228)..(228): Xaa can be any naturally occurring amino acid
  misc_feature (233)..(233): Xaa can be any naturally occurring amino acid
  MISC_FEATURE (236)..(236): Xaa represents Leucine or Isoleucine
  misc_feature (243)..(243): Xaa can be any naturally occurring amino acid
  misc_feature (245)..(245): Xaa can be any naturally occurring amino acid
  misc_feature (262)..(262): Xaa can be any naturally occurring amino acid
  MISC_FEATURE (267)..(267): Xaa represents Leucine or Isoleucine
  misc_feature (277)..(278): Xaa can be any naturally occurring amino acid
  misc_feature (282)..(282): Xaa can be any naturally occurring amino acid
  misc_feature (287)..(287): Xaa can be any naturally occurring amino acid
  misc_feature (307)..(307): Xaa can be any naturally occurring amino acid
  misc_feature (314)..(314): Xaa can be any naturally occurring amino acid
  misc_feature (320)..(321): Xaa can be any naturally occurring amino acid
  misc_feature (333)..(333): Xaa can be any naturally occurring amino acid
  misc_feature (343)..(343): Xaa can be any naturally occurring amino acid
  misc_feature (357)..(357): Xaa can be any naturally occurring amino acid
  misc_feature (367)..(367): Xaa can be any naturally occurring amino acid
  misc_feature (371)..(371): Xaa can be any naturally occurring amino acid
  misc_feature (374)..(375): Xaa can be any naturally occurring amino acid
  misc_feature (378)..(378): Xaa can be any naturally occurring amino acid
  misc_feature (392)..(392): Xaa can be any naturally occurring amino acid
  misc_feature (402)..(402): Xaa can be any naturally occurring amino acid
  misc_feature (414)..(415): Xaa can be any naturally occurring amino acid
  MISC_FEATURE (418)..(418): Xaa represents Leucine or Isoleucine
  misc_feature (446)..(446): Xaa can be any naturally occurring amino acid
  misc_feature (448)..(449): Xaa can be any naturally occurring amino acid
  misc_feature (451)..(451): Xaa can be any naturally occurring amino acid
  misc_feature (467)..(467): Xaa can be any naturally occurring amino acid
  misc_feature (489)..(489): Xaa can be any naturally occurring amino acid
  misc_feature (500)..(500): Xaa can be any naturally occurring amino acid
  misc_feature (510)..(510): Xaa can be any naturally occurring amino acid
  misc_feature (514)..(514): Xaa can be any naturally occurring amino acid
  misc_feature (528)..(529): Xaa can be any naturally occurring amino acid
  misc_feature (532)..(532): Xaa can be any naturally occurring amino acid
  misc_feature (539)..(539): Xaa can be any naturally occurring amino acid
  misc_feature (547)..(548): Xaa can be any naturally occurring amino acid
  misc_feature (551)..(551): Xaa can be any naturally occurring amino acid
  misc_feature (553)..(554): Xaa can be any naturally occurring amino acid
  misc_feature (565)..(565): Xaa can be any naturally occurring amino acid
  misc_feature (576)..(576): Xaa can be any naturally occurring amino acid
  misc_feature (587)..(588): Xaa can be any naturally occurring amino acid
  misc_feature (600)..(600): Xaa can be any naturally occurring amino acid
  misc_feature (604)..(605): Xaa can be any naturally occurring amino acid
  misc_feature (622)..(622): Xaa can be any naturally occurring amino acid
  misc_feature (627)..(627): Xaa can be any naturally occurring amino acid
  misc_feature (629)..(629): Xaa can be any naturally occurring amino acid
  misc_feature (655)..(655): Xaa can be any naturally occurring amino acid
  misc_feature (662)..(662): Xaa can be any naturally occurring amino acid
  misc_feature (682)..(682): Xaa can be any naturally occurring amino acid
  misc_feature (686)..(686): Xaa can be any naturally occurring amino acid
  MISC_FEATURE (688)..(688): Xaa represents Leucine or Isoleucine
  misc_feature (691)..(691): Xaa can be any naturally occurring amino acid
  misc_feature (698)..(698): Xaa can be any naturally occurring amino acid
  misc_feature (706)..(706): Xaa can be any naturally occurring amino acid
  misc_feature (723)..(723): Xaa can be any naturally occurring amino acid
  MISC_FEATURE (737)..(737): Xaa represents Leucine or Isoleucine
  misc_feature (738)..(738): Xaa can be any naturally occurring amino acid
  misc_feature (760)..(761): Xaa can be any naturally occurring amino acid
  misc_feature (771)..(771): Xaa can be any naturally occurring amino acid
  misc_feature (773)..(773): Xaa can be any naturally occurring amino acid
  misc_feature (779)..(779): Xaa can be any naturally occurring amino acid
  misc_feature (786)..(786): Xaa can be any naturally occurring amino acid
  misc_feature (790)..(790): Xaa can be any naturally occurring amino acid
  misc_feature (798)..(798): Xaa can be any naturally occurring amino acid
  misc_feature (800)..(800): Xaa can be any naturally occurring amino acid
  misc_feature (834)..(834): Xaa can be any naturally occurring amino acid
  misc_feature (843)..(843): Xaa can be any naturally occurring amino acid
  misc_feature (851)..(852): Xaa can be any naturally occurring amino acid
  misc_feature (866)..(866): Xaa can be any naturally occurring amino acid
  misc_feature (870)..(870): Xaa can be any naturally occurring amino acid
  misc_feature (873)..(873): Xaa can be any naturally occurring amino acid
  misc_feature (877)..(877): Xaa can be any naturally occurring amino acid
  misc_feature (889)..(889): Xaa can be any naturally occurring amino acid
  misc_feature (896)..(896): Xaa can be any naturally occurring amino acid
  misc_feature (916)..(916): Xaa can be any naturally occurring amino acid
  misc_feature (923)..(923): Xaa can be any naturally occurring amino acid
  misc_feature (936)..(936): Xaa can be any naturally occurring amino acid
  misc_feature (962)..(962): Xaa can be any naturally occurring amino acid
  misc_feature (966)..(966): Xaa can be any naturally occurring amino acid
  misc_feature (970)..(970): Xaa can be any naturally occurring amino acid
  misc_feature (985)..(985): Xaa can be any naturally occurring amino acid
  misc_feature (996)..(996): Xaa can be any naturally occurring amino acid
MKISKVXXXVXKKXXXGKLXKXVNERNRXAKRLSNXLBKYIXXIDKIXKKEXXKKFXAXEEITLKLNQXXXBXLXKAXXDLRKDNXYSXXKKILHNEDINXEEXELLINDXLEKLXKIESXKYSYQKXXXNYXMSVQEHSKKSIXRIXESAKRNKEALDKFLKEYAXLDPRMEXLAKLRKLLELYFYFKNDXIXXEEEXNVXXHKXLKENHPDFVEXXXNKENAELNXYAIEXKKXLKYYFPXKXAKNSNDKIFEKQELKKXWIHQXENAVERILLXXGKVXYKLQXGYLAELWKIRINEIFIKYIXVGKAVAXFALRNXXKBENDILGGKIXKKLNGITSFXYEKIKAEEILQREXAVEVAFAANXLYAXDLXXIRXSILQFFGGASNWDXFLFFHFATSXISDKKWNAELIXXKKXGLVIREKLYSNNVAMFYSKDDLEKLLNXLXXFXLRASQVPSFKKVYVRXBFPQNLLKKFNDEKDDEAYSAXYYLLKEIYYNXFLPYFSANNXFFFXVKNLVLKANKDKFXXAFXDIREMNXGSPIEYLXXTQXNXXNEGRKKEEKEXDFIKFLLQIFXKGFDDYLKNNXXFILKFIPEPTEXIEIXXELQAWYIVGKFLNARKXNLLGXFXSYLKLLDDIELRALRNENIKYQSSNXEKEVLEXCLELIGLLSLDLNDYFBDEXDFAXYXGKXLDFEKKXMKDLAELXPYDQNDGENPIVNRNIXLAKKYGTLNLLEKXXDKVSEKEIKEYYELKKEIEEYXXKGEELHEEWXQXKNRVEXRDILEYXEELXGQIINYNXLXNKVLLYFQLGLHYLLLDILGRLVGYTGIWERDAXLYQIAAMYXNGLPEYIXXKKNDKYKDGQIVGXKINXFKXDKKXLYNAGLELFENXNEHKNIXIRNYIAHFNYLSKAESSLLXYSENLRXLFSYDRKLKNAVXKSLINILLRHGMVLKFKFGTDKKSVXIRSXKKIXHLKSIAKKLYYPEVXVSKEYCKLVKXLLKYK

SEQ ID NO: 33 - protein, 1224 aa, Bergeyella zoohelcum
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 34 - protein, 1126 aa, Prevotella intermedia
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 35 - protein, 1127 aa, Prevotella buccae
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 36 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFAVFFKPDDFVLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLDEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELRLLDPSSGHPFLSATMETAHRYTEGFYKCYLEKKREWLAKIFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 37 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETAECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTSGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPLPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 38 - protein, 953 aa, Alistipes sp.
MSNEIGAFREHQFAYAPGNEKQEEATFATYFNLALSNVEGMMFGEVESNPDKIEKSLDTLPPAILRQIASFIWLSKEDHPDKAYSTEEVKVIVTDLVRRLCFYRNYFSHCFYLDTQYFYSDELVDTTAIGEKLPYNFHHFITNRLFRYSLPEITLFRWNEGERKYEILRDGLIFFCCLFLKRGQAERFLNELRFFKRTDEEGRIKRTIFTKYCTRESHKHIGIEEQDFLIFQDIIGDLNRVPKVCDGVVDLSKENERYIKNRETSNESDENKARYRLLIREKDKFPYYLMRYIVDFGVLPCITFKQNDYSTKEGRGQFHYQDAAVAQEERCYNFVVRNGNVYYSYMPQAQNVVRISELQGTISVEELRNMVYASINGKDVNKSVEQYLYHLHLLYEKILTISGQTIKEGRVDVEDYRPLLDKLLLRPASNGEELRRELRKLLPKRVCDLLSNRFDCSEGVSAVEKRLKAILLRHEQLLLSQNPALHIDKIKSVIDYLYLFFSDDEKFRQQPTEKAHRGLKDEEFQMYHYLVGDYDSHPLALWKELEASGRLKPEMRKLTSATSLHGLYMLCLKGTVEWCRKQLMSIGKGTAKVEAIADRVGLKLYDKLKEYTPEQLEREVKLVVMHGYAAAATPKPKAQAAIPSKLTELRFYSFLGKREMSFAAFIRQDKKAQKLWLRNFYTVENIKTLQKRQAAADAACKKLYNLVGEVERVHTNDKVLVLVAQRYRERLLNVGSKCAVTLDNPERQQKLADVYEVQNAWLSIRFDDLDFTLTHVNLSNLRKAYNLIPRKHILAFKEYLDNRVKQKLCEECRNVRRKEDLCTCCSPRYSNLTSWLKENHSESSIEREAATMMLLDVERKLLSFLLDERRKAIIEYGKFIPFSALVKECRLADAGLCGIRNDVLHDNVISYADAIGKLSAYFPKEASEAVEYIRRTKEVREQRREELMANSSQ

SEQ ID NO: 39 - protein, 1322 aa, Prevotella sp.
MSKECKKQRQEKKRRLQKANFSISLTGKHVFGAYFNMARTNFVKTINYILPIAGVRGNYSENQINKMLHALFLIQAGRNEELTTEQKQWEKKLRLNPEQQTKFQKLLFKHFPVLGPMMADVADHKAYLNKKKSTVQTEDETFAMLKGVSLADCLDIICLMADTLTECRNFYTHKDPYNKPSQLADQYLHQEMIAKKLDKVVVASRRILKDREGLSVNEVEFLTGIDHLHQEVLKDEFGNAKVKDGKVMKTFVEYDDFYFKISGKRLVNGYTVTTKDDKPVNVNTMLPALSDFGLLYFCVLFLSKPYAKLFIDEVRLFEYSPFDDKENMIMSEMLSIYRIRTPRLHKIDSHDSKATLAMDIFGELRRCPMELYNLLDKNAGQPFFHDEVKHPNSHTPDVSKRLRYDDRFPTLALRYIDETELFKRIRFQLQLGSFRYKFYDKENCIDGRVRVRRIQKEINGYGRMQEVADKRMDKWGDLIQKREERSVKLEHEELYINLDQFLEDTADSTPYVTDRRPAYNIHANRIGLYWEDSQNPKQYKVFDENGMYIPELVVTEDKKAPIKMPAPRCALSVYDLPAMLFYEYLREQQDNEFPSAEQVIIEYEDDYRKFFKAVAEGKLKPFKRPKEFRDFLKKEYPKLRMADIPKKLQLFLCSHGLCYNNKPETVYERLDRLTLQHLEERELHIQNRLEHYQKDRDMIGNKDNQYGKKSFSDVRHGALARYLAQSMMEWQPTKLKDKEKGHDKLTGLNYNVLTAYLATYGHPQVPEEGFTPRTLEQVLINAHLIGGSNPHPFINKVLALGNRNIEELYLHYLEEELKHIRSRIQSLSSNPSDKALSALPFIHHDRMRYHERTSEEMMALAARYTTIQLPDGLFTPYILEILQKHYTENSDLQNALSQDVPVKLNPTCNAAYLITLFYQTVLKDNAQPFYLSDKTYTRNKDGEKAESFSFKRAYELFSVLNNNKKDTFPFEMIPLFLTSDEIQERLSAKLLDGDGNPVPEVGEKGKPATDSQGNTIWKRRIYSEVDDYAEKLTDRDMKISFKGEWEKLPRWKQDKIIKRRDETRRQMRDELLQRMPRYIRDIKDNERTLRRYKTQDMVLFLLAEKMFTNIISEQSSEFNWKQMRLSKVCNEAFLRQTLTFRVPVTVGETTIYVEQENMSLKNYGEFYRFLTDDRLMSLLNNIVETLKPNENGDLVIRHTDLMSELAAYDQYRSTIFMLIQSIENLIITNNAVLDDPDADGFWVREDLPKRNNFASLLELINQLNNVELTDDERKLLVAIRNAFSHNSYNIDFSLIKDVKHLPEVAKGILQHLQSMLGVEITK

SEQ ID NO: 40 - protein, 1322 aa, Prevotella sp.; identical to SEQ ID NO: 39

SEQ ID NO: 41 - protein, 1095 aa, Riemerella anatipestifer
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 42 - protein, 1124 aa, Prevotella aurantiaca
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRILMPKLRLESTQTQDWILLDMLNELIRCPKSLYERLQGDDREKFKVPFDPADEDYNAEQEPFKNTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKDFLHREERIELWDKKKDKFKGYKEKIKSKKLTEKDKEEFRSYLEFQSWNKFERELRLVRNQDIVTWLLCKELIDKLKIDELNIEELKKLRLNNIDTDTAKKEKNNILNRVMPMELPVTVYEIDDSHKIVKDKPLHTIYIKEAETKLLKQGNFKALVKDRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 43 - protein, 1151 aa, Prevotella saccharolytica
MEDKPFWAAFFNLARHNVYLTVNHINKLLDLEKLYDEGKHKEIFEREDIFNISDDVMNDANSNGKKRKLDIKKIWDDLDTDLTRKYQLRELILKHFPFIQPAIIGAQTKERTTIDKDKRSTSTSNDSLKQTGEGDINDLLSLSNVKSMFFRLLQILEQLRNYYSHVKHSKSATMPNFDEDLLNWMRYIFIDSVNKVKEDYSSNSVIDPNTSFSHLIYKDEQGKIKPCRYPFTSKDGSINAFGLLFFVSLFLEKQDSIWMQKKIPGFKKASENYMKMTNEVFCRNHILLPKIRLETVYDKDWMLLDMLNEVVRCPLSLYKRLTPAAQNKFKVPEKSSDNANRQEDDNPFSRILVRHQNRFPYFVLRFFDLNEVFTTLRFQINLGCYHFAICKKQIGDKKEVHHLIRTLYGFSRLQNFTQNTRPEEWNTLVKTTEPSSGNDGKTVQGVPLPYISYTIPHYQIENEKIGIKIFDGDTAVDTDIWPSVSTEKQLNKPDKYTLTPGFKADVFLSVHELLPMMFYYQLLLCEGMLKTDAGNAVEKVLIDTRNAIFNLYDAFVQEKINTITDLENYLQDKPILIGHLPKQMIDLLKGHQRDMLKAVEQKKAMLIKDTERRLKLLDKQLKQETDVAAKNTGTLLKNGQIADWLVNDMMRFQPVKRDKEGNPINCSKANSTEYQMLQRAFAFYATDSCRLSRYFTQLHLIHSDNSHLFLSRFEYDKQPNLIAFYAAYLKAKLEFLNELQPQNWASDNYFLLLRAPKNDRQKLAEGWKNGFNLPRGLFTEKIKTWFNEHKTIVDISDCDIFKNRVGQVARLIPVFFDKKFKDHSQPFYRYDFNVGNVSKPTEANYLSKGKREELFKSYQNKFKNNIPAEKTKEYREYKNFSLWKKFERELRLIKNQDILIWLMCKNLFDEKIKPKKDILEPRIAVSYIKLDSLQTNTSTAGSLNALAKVVPMTLAIHIDSPKPKGKAGNNEKENKEFTVYIKEEGTKLLKWGNFKTLLADRRIKGLFSYIEHDDIDLKQHPLTKRRVDLELDLYQTCRIDIFQQTLGLEAQLLDKYSDLNTDNFYQMLIGWRKKEGIPRNIKEDTDFLKDVRNAFSHNQYPDSKKIAFRRIRKFNPKELILEEEEGLGIATQMYKEVEKVVNRIKRIELFD

SEQ ID NO: 44 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 45 - protein, 1120 aa, Prevotella intermedia
MEDDKKTTDSIRYELKDKHFWAAFLNLARHNVYITVNHINKILEEDEINRDGYENTLENSWNEIKDINKKDRLSKLIIKHFPFLEATTYRQNPTDTTKQKEEKQAEAQSLESLKKSFFVFIYKLRDLRNHYSHYKHSKSLERPKFEEDLQNKMYNIFDVSIQFVKEDYKHNTDINPKKDFKHLDRKRKGKFHYSFADNEGNITESGLLFFVSLFLEKKDAIWVQKKLEGFKCSNKSYQKMTNEVFCRSRMLLPKLRLESTQTQDWILLDMLNELIRCPKSLYERLQGVNRKKFYVSFDPADEDYDAEQEPFKNTLVRHQDRFPYFALRYFDYNEVFANLRFQIDLGTYHFSIYKKLIGGQKEDRHLTHKLYGFERIQEFDKQNRPDEWKAIVKDSDTFKKKEEKEEEKPYISETTPHYHLENKKIGIAFKNHNIWPSTQTELTNNKRKKYNLGTSIKAEAFLSVHELLPMMFYYLLLKTENTKNDNKVGGKKETKKQGKHKIEAIIESKIKDIYALYDAFANGEINSEDELKEYLKGKDIKIVHLPKQMIAILKNEHKDMAEKAEAKQEKMKLATENRLKTLDKQLKGKIQNGKRYNSAPKSGEIASWLVNDMMRFQPVQKDENGESLNNSKANSTEYQLLQRTLAFFGSEHERLAPYFKQTKLIESSNPHPFLNDTEWEKCSNILSFYRSYLKARKNFLESLKPEDWEKNQYFLMLKEPKTNRETLVQGWKNGFNLPRGFFTEPIRKWFMEHWKSIKVDDLKRVGLVAKVTPLFFSEKYKDSVQPFYNYPFNVGDVNKPKEEDFLHREERIELWDKKKDKFKGYKAKKKFKEMTDKEKEEHRSYLEFQSWNKFERELRLVRNQDIVTWLLCTELIDKLKIDELNIKELKKLRLKDINTDTAKKEKNNILNRVMPMELPVTVYKVNKGGYIIKNKPLHTIYIKEAETKLLKQGNFKALVKDRRLNGLFSFVKTPSEAESESNPISKLRVEYELGKYQNARLDIIEDMLALEKKLIDKYNSLDTDNFHNMLTGWLELKGEAKKARFQNDVKLLTAVRNAFSHNQYPMYDENLFGNIERFSLSSSNIIESKGLDIAAKLKEEVSKAAKKIQNEEDNKKEKET

SEQ ID NO: 46 - protein, 1199 aa, Capnocytophaga canimorsus
MKNIQRLGKGNEFSPFKKEDKFYFGGFLNLANNNIEDFFKEIITRFGIVITDENKKPKETFGEKILNEIFKKDISIVDYEKWVNIFADYFPFTKYLSLYLEEMQFKNRVICFRDVMKELLKTVEALRNFYTHYDHEPIKIEDRVFYFLDKVLLDVSLTVKNKYLKTDKTKEFLNQHIGEELKELCKQRKDYLVGKGKRIDKESEIINGIYNNAFKDFICKREKQDDKENHNSVEKILCNKEPQNKKQKSSATVWELCSKSSSKYTEKSFPNRENDKHCLEVPISQKGIVFLLSFFLNKGEIYALTSNIKGFKAKITKEEPVTYDKNSIRYMATHRMFSFLAYKGLKRKIRTSEINYNEDGQASSTYEKETLMLQMLDELNKVPDVVYQNLSEDVQKTFIEDWNEYLKENNGDVGTMEEEQVIHPVIRKRYEDKFNYFAIRFLDEFAQFPTLRFQVHLGNYLCDKRTKQICDTTTEREVKKKITVFGRLSELENKKAIFLNEREEIKGWEVFPNPSYDFPKENISVNYKDFPIVGSILDREKQPVSNKIGIRVKIADELQREIDKAIKEKKLRNPKNRKANQDEKQKERLVNEIVSTNSNEQGEPVVFIGQPTAYLSMNDIHSVLYEFLINKISGEALETKIVEKIETQIKQIIGKDATTKILKPYTNANSNSINREKLLRDLEQEQQILKTLLEEQQQREKDKKDKKSKRKHELYPSEKGKVAVWLANDIKRFMPKAFKEQWRGYHHSLLQKYLAYYEQSKEELKNLLPKEVFKHFPFKLKGYFQQQYLNQFYTDYLKRRLSYVNELLLNIQNFKNDKDALKATEKECFKFFRKQNYIINPINIQIQSILVYPIFLKRGFLDEKPTMIDREKFKENKDTELADWFMHYKNYKEDNYQKFYAYPLEKVEEKEKFKRNKQINKQKKNDVYTLMMVEYIIQKIFGDKFVEENPLVLKGIFQSKAERQQNNTHAATTQERNLNGILNQPKDIKIQGKITVKGVKLKDIGNFRKYEIDQRVNTFLDYEPRKEWMAYLPNDWKEKEKQGQLPPNNVIDRQISKYETVRSKILLKDVQELEKIISDEIKEEHRHDLKQGKYYNFKYYILNGLLRQLKNENVENYKVFKLNTNPEKVNITQLKQEATDLEQKAFVLTYIRNKFAHNQLPKKEFWDYCQEKYGKIEKEKTYAEYFAEVFKREKEALIK

SEQ ID NO: 47 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKIDHEHNDEVDPHYHFNHLVRKGKKDRYGHNDNPSFKHHFVDGEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAERVQGRIKRVIEDVYAVYDAFARDEINTRDELDACLADKGIRRGHLPRQMIAILSQEHKDMEEKIRKKLQEMMADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENRPFLLLKEPKTDRQTLVAGWKGEFHLPRGIFTEAVRDCLIEMGHDEVASYKEVGFMAKAVPLYFERACEDRVQPFYDSPFNVGNSLKPKKGRFLSKEERAEEWERGKERFRDLEAWSYSAARRIEDAFAGIEYASPGNKKKIEQLLRDLSLWEAFESKLKVRADRINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 48 - protein, 1090 aa, Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMK

SEQ ID NO: 49 - protein, 1150 aa, Flavobacterium branchiophilum
MENLNKILDKENEICISKIFNTKGIAAPITEKALDNIKSKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKKK

SEQ ID NO: 50 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVTHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHIELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 51 - protein, 1214 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLIPFLEENKTDDKQNKTVSLRKYRKSKPNEETSITLTQSGLVFLMSFFLHRKEFQVFTSGLERFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNALQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLSTESTFLENGFIGLPPKILKKELSKRLKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKLNDSSLWNKVIHLSLQNNRITANPKLKDIGKYKRALQDEKIATLLTYDARTWTYALQKPEKENENDYKELHYTALNMELQEYEKVRSKELLKQVQELEKKILDKFYDFSNNASHPEDLEIEDKKGKRHPNFKLYITKALLKNESEIINLENIDIEILLKYYDYNTEELKEKIKNMDEDEKAKIINTKENYNKITNVLIKKALVLIIIRNKMAHNQYPPKFIYDLANRFVPKKEEEYFATYFNRVFETITKELWENKEKKDKTQV

SEQ ID NO: 52 - protein, 1119 aa, Porphyromonas gingivalis
MTEQNEKPYNGTYYTLEDKHFWAAFLNLARHNAYITLAHIDRQLAYSKADITNDEDILFFKGQWKNLDNDLERKARLRSLILKHFSFLEGAAYGKKLFESQSSGNKSSKKKELSKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVVADWLVRDMMRFQPVAKDTSGKPLNNSKANSTEYRMLQRALALFGGEKERLTPYFRQMNLTGGNNPHPFLHETRWESHTNILSFYRSYLEARKAFLQSIGRSDRVENHRFLLLKEPKTDRQTLVAGWKGEFHLPRGIFTEAVRDCLIEMGYDEVGSYKEVGFMAKAVPLYFERASKDRVQPFYDYPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 53 - protein, 1175 aa, Porphyromonas sp.
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEDRAEEWERGKERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 54 - protein, 1132 aa, Prevotella intermedia
MEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 55 - protein, 1134 aa, Prevotella intermedia
MKMEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 56 - protein, 1133 aa, Prevotella intermedia
MEDDKKTTDSISYELKDKHFWAAFLNLARHNVYITVNHINKVLELKNKKDQDIIIDNDQDILAIKTHWEKVNGDLNKTERLRELMTKHFPFLETAIYSKNKEDKEEVKQEKQAKAQSFDSLKHCLFLFLEKLQETRNYYSHYKYSESTKEPMLEKELLKKMYNIFDDNIQLVIKDYQHNKDINPDEDFKHLDRTEEDFNYYFTRNKKGNITESGLLFFVSLFLEKKDAIWMQQKLRGFKDNRESKKKMTHEVFCRSRMLLPKLRLESTQTQDWILLDMLNELIRCPKSLYERLQGEDREKFKVPFDPADEDYDAEQEPFKNTLVRHQDRFPYFALRYFDYNEIFTNLRFQIDLGTFHFSIYKKLIGGQKEDRHLTHKLYGFERIQEFAKQNRPDEWKAIVKDLDTYETSNERYISETTPHYHLENQKIGIRFRNDNDEIWPSLKTNGENNEKSKYKLDKQYQAEAFLSVHELLPMMFYYLLLKKEEPNNDKKNASIVEGFIKREIRDMYKLYDAFANGEINNIDDLEKYCEDKGIPKRHLPKQMVAILYDEHKDMVKEAKRKQRKMVKDTEKLLAALEKQTQEKTEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSKEYEKVEALDRVGLVTKVIPLFFKKEDSKDKEEDLKKDAQKEINNCVQPFYSFPYNVGNIHKPDEKDFLHREERIELWDKKKDKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSEAELKSNPISKSLVEYELGEYQNARIETIKDMLLLEETLIEKYKNLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 57 - protein, 1127 aa, Prevotella buccae; identical to SEQ ID NO: 35

SEQ ID NO: 58 - protein, 1125 aa, Prevotella pallens
MKEEEKGKTPVVSTYNKDDKHFWAAFLNLARHNVYITVNHINKILGEGEINRDGYENTLEKSWNEIKDINKKDRLSKLIIKHFPFLEVTTYQRNSADTTKQKEEKQAEAQSLESLKKSFFVFIYKLRDLRNHYSHYKHSKSLERPKFEEDLQEKMYNIFDASIQLVKEDYKHNTDIKTEEDFKHLDRKGQFKYSFADNEGNITESGLLFFVSLFLEKKDAIWVQKKLEGFKCSNESYQKMTNEVFCRSRMLLPKLRLQSTQTQDWILLDMLNELIRCPKSLYERLREEDRKKFRVPIEIADEDYDAEQEPFKNALVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDAFANGKINSIDKLEEYCKGKDIEIGHLPKQMIAILKSEHKDMATEAKRKQEEMLADVQKSLESLDNQINEEIENVERKNSSLKSGEIASWLVNDMMRFQPVQKDNEGNPLNNSKANSTEYQMLQRSLALYNKEEKPTRYFRQVNLIESSNPHPFLNNTEWEKCNNILSFYRSYLEAKKNFLESLKPEDWEKNQYFLMLKEPKTNCETLVQGWKNGFNLPRGIFTEPIRKWFMEHRKNITVAELKRVGLVAKVIPLFFSEEYKDSVQPFYNYLFNVGNINKPDEKNFLNCEERRELLRKKKDEFKKMTDKEKEENPSYLEFQSWNKFERELRLVRNQDIVTWLLCMELFNKKKIKELNVEKIYLKNINTNTTKKEKNTEEKNGEEKIIKEKNNILNRIMPMRLPIKVYGRENFSKNKKKKIRRNTFFTVYIEEKGTKLLKQGNFKALERDRRLGGLFSFVKTHSKAESKSNTISKSRVEYELGEYQKARIEIIKDMLALEETLIDKYNSLDTDNFHNMLTGWLKLKDEPDKASFQNDVDLLIAVRNAFSHNQYPMRNRIAFANINPFSLSSANTSEEKGLGIANQLKDKTHKTIEKIIEIEKPIETKE

SEQ ID NO: 59 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKANYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMTEEFKSKWKGYQHTELQKLFAYYDTSKSDLDLILSDMVMVKDYPIELIALVKKSRTLVDFLNKYLEARLGYMENVITRVKNSIGTPQFKTVRKECFTFLKKSNYTVVSLDKQVERILSMPLFIERGFMDDKPTMLEGKSYQQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCEGLVRIDKVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLVPIGMDVREMLILSTDVKFIKEEIIQLGQAGEVEQDLYSLIYIRNKFAHNQLPIKEFFDFCENNYRSISDNEYYAEYYMEIFRSIKEKYTS

SEQ ID NO: 60 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSDMVMVKDYPIELIDLVRKSRTLVDFLNKYLEARLGYIENVITRVKNSIGTPQFKTVRKECFAFLKESNYTVASLDKQIERILSMPLFIERGFMDSKPTMLEGKSYQQHKEDFADWFVHYKENSNYQNFYDTEVYEIITEDKREQAKVTKKIKQQQKNDVFTLMMVNYMLEEVLKLPSNDRLSLNELYQTKEERIVNKQVAKDTQERNKNYIWNKVVDLQLCEGLVRIDKVKLKDIGNFRKYENDSRVKEFLTYQSDIVWSGYLSNEVDSNKLYVIERQLDNYESIRSKELLKEVQEIECIVYNQVANKESLKQSGNENFKQYVLQGLLPRGTDVREMLILSTDVKFKKEEIMQLGQVREVEQDLYSLIYIRNKFAHNQLPIKEFFDFCENNYRPISDNEYYAEYYMEIFRSIKEKYAS

SEQ ID NO: 61 - protein, 1224 aa, Bergeyella zoohelcum; identical to SEQ ID NO: 33

SEQ ID NO: 62 - protein, 1150 aa, Prevotella saccharolytica
MMEKENVQGSHIYYEPTDKCFWAAFYNLARHNAYLTIAHINSFVNSKKGINNDDKVLDIIDDWSKFDNDLLMGARLNKLILKHFPFLKAPLYQLAKRKTRKQQGKEQQDYEKKGDEDPEVIQEAIANAFKMANVRKTLHAFLKQLEDLRNHFSHYNYNSPAKKMEVKFDDGFCNKLYYVFDAALQMVKDDNRMNPEINMQTDFEHLVRLGRNRKIPNTFKYNFTNSDGTINNNGLLFFVSLFLEKRDAIWMQKKIKGFKGGTENYMRMTNEVFCRNRMVIPKLRLETDYDNHQLMFDMLNELVRCPLSLYKRLKQEDQDKFRVPIEFLDEDNEADNPYQENANSDENPTEETDPLKNTLVRHQHRFPYFVLRYFDLNEVFKQLRFQINLGCYHFSIYDKTIGERTEKRHLTRTLFGFDRLQNFSVKLQPEHWKNMVKHLDTEESSDKPYLSDAMPHYQIENEKIGIHFLKTDTEKKETVWPSLEVEEVSSNRNKYKSEKNLTADAFLSTHELLPMMFYYQLLSSEEKTRAAAGDKVQGVLQSYRKKIFDIYDDFANGTINSMQKLDERLAKDNLLRGNMPQQMLAILEHQEPDMEQKAKEKLDRLITETKKRIGKLEDQFKQKVRIGKRRADLPKVGSIADWLVNDMMRFQPAKRNADNTGVPDSKANSTEYRLLQEALAFYSAYKDRLEPYFRQVNLIGGTNPHPFLHRVDWKKCNHLLSFYHDYLEAKEQYLSHLSPADWQKHQHFLLLKVRKDIQNEKKDWKKSLVAGWKNGFNLPRGLFTESIKTWFSTDADKVQITDTKLFENRVGLIAKLIPLYYDKVYNDKPQPFYQYPFNINDRYKPEDTRKRFTAASSKLWNEKKMLYKNAQPDSSDKIEYPQYLDFLSWKKLERELRMLRNQDMMVWLMCKDLFAQCTVEGVEFADLKLSQLEVDVNVQDNLNVLNNVSSMILPLSVYPSDAQGNVLRNSKPLHTVYVQENNTKLLKQGNFKSLLKDRRLNGLFSFIAAEGEDLQQHPLTKNRLEYELSIYQTMRISVFEQTLQLEKAILTRNKTLCGNNFNNLLNSWSEHRTDKKTLQPDIDFLIAVRNAFSHNQYPMSTNTVMQGIEKFNIQTPKLEEKDGLGIASQLAKKTKDAASRLQNIINGGTN

SEQ ID NO: 63 - protein, 1175 aa, Porphyromonas gingivalis
MTEQNEKPYNGTYYTLEDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAERVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 64 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETTECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTGGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPVPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 65 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 66 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 67 - protein, 1092 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKIMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEIPLIYRDVSAKVGSIEGSSAKDLPEG

SEQ ID NO: 68 - protein, 1125 aa, Prevotella intermedia
MKMEDDKKTTESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAEAQSLESLKDCLFLFLEKLQEARNYYSHYKYSESTKEPMLEEGLLEKMYNIFDDNIQLVIKDYQHNKDINPDEDFKHLDRKGQFKYSFADNEGNITESGLLFFVSLFLEKKDAIWMQQKLTGFKDNRESKKKMTHEVFCRRRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRPDEWKALVKDLDTYETSNERYISETTPHYHLENQKIGIRFRNGNKEIWPSLKTNGENNEKSKYKLDKPYQAEAFLSVHELLPMMFYYLLLKKEEPNNDKKNASIVEGFIKREIRDMYKLYDAFANGEINNIGDLEKYCEDKGIPKRHLPKQMVAILYDEPKDMVKEAKRKQKEMVKDTKKLLATLEKQTQEEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRNYLTKKIEFLNKLKPEDWEKNQYFLKLKEPKTNRETLVQGWKNGFNLPRGIFTEPIREWFKRHQNDSKEYEKVEALKRVGLVTKVIPLFFKEEYFKEDAQKEINNCVQPFYSFPYNVGNIHKPDEKDFLPSEERKKLWGDKKDKFKGYKAKVKSKKLTDKEKEEYRSYLEFQSWNKFERELRLVRNQDIVTWLLCTELIDKMKVEGLNVEELQKLRLKDIDTDTAKQEKNNILNRIMPMQLPVTVYEIDDSHNIVKDRPLHTVYIEETKTKLLKQGNFKALVKDRRLNGLFSFVDTSSKAELKDKPISKSVVEYELGEYQNARIETIKDMLLLEKTLIKKYEKLPTDNFSDMLNGWLEGKDESDKARFQNDVKLLVAVRNAFSHNQYPMRNRIAFANINPFSLSSADISEEKKLDIANQLKDKTHKIIKKIIEIEKPIETKE

SEQ ID NO: 69 - protein, 1161 aa, Bacteroidetes bacterium
MENQTQKGKGIYYYYTKNEDKHYFGSFLNLANNNIEQIIEEFRIRLSLKDEKNIKEIINNYFTDKKSYTDWERGINILKEYLPVIDYLDLAITDKEFEKIDLKQKETAKRKYFRTNFSLLIDTIIDLRNFYTHYFHKPISINPDVAKFLDKNLLNVCLDIKKQKMKTDKTKQALKDGLDKELKKLIELKKAELKEKKIKTWNITENVEGAVYNDAFNHMVYKNNAGVTILKDYHKSILPDDKIDSELKLNFSISGLVFLLSMFLSKKEIEQFKSNLEGFKGKVIGENGEYEISKFNNSLKYMATHWIFSYLTFKGLKQRVKNTFDKETLLMQMIDELNKVPHEVYQTLSKEQQNEFLEDINEYVQDNEENKKSMENSIVVHPVIRKRYDDKFNYFAIRFLDEFANFPTLKFFVTAGNFVHDKREKQIQGSMLTSDRMIKEKINVFGKLTEIAKYKSDYFSNENTLETSEWELFPNPSYLLIQNNIPVHIDLIHNTEEAKQCQIAIDRIKCTTNPAKKRNTRKSKEEIIKIIYQKNKNIKYGDPTALLSSNELPALIYELLVNKKSGKELENIIVEKIVNQYKTIAGFEKGQNLSNSLITKKLKKSEPNEDKINAEKIILAINRELEITENKLNIIKNNRAEFRTGAKRKHIFYSKELGQEATWIAYDLKRFMPEASRKEWKGFHHSELQKFLAFYDRNKNDAKALLNMFWNFDNDQLIGNDLNSAFREFHFDKFYEKYLIKRDEILEGFKSFISNFKDEPKLLKKGIKDIYRVFDKRYYIIKSTNAQKEQLLSKPICLPRGIFDNKPTYIEGVKVESNSALFADWYQYTYSDKHEFQSFYDMPRDYKEQFEKFELNNIKSIQNKKNLNKSDKFIYFRYKQDLKIKQIKSQDLFIKLMVDELFNVVFKNNIELNLKKLYQTSDERFKNQLIADVQKNREKGDTSDNKMNENFIWNMTIPLSLCNGQIEEPKVKLKDIGKFRKLETDDKVIQLLEYDKSKVWKKLEIEDELENMPNSYERIRREKLLKGIQEFEHFLLEKEKFDGINHPKHFEQDLNPNFKTYVINGVLRKNSKLNYTEIDKLLDLEHISIKDIETSAKEIHLAYFLIHVRNKFGHNQLPKLEAFELMKKYYKKNNEETYAEYFHKVSSQIVNEFKNSLEKHS

SEQ ID NO: 70 - protein, 1165 aa, Chryseobacterium jejuense
MEKTQTGLGIYYDHTKLQDKYFFGGFFNLAQNNIDNVIKAFIIKFFPERKDKDINIAQFLDICFKDNDADSDFQKKNKFLRIHFPVIGFLTSDNDKAGFKKKFALLLKTISELRNFYTHYYHKSIEFPSELFELLDDIFVKTTSEIKKLKKKDDKTQQLLNKNLSEEYDIRYQQQIERLKELKAQGKRVSLTDETAIRNGVFNAAFNHLIYRDGENVKPSRLYQSSYSEPDPAENGISLSQNSILFLLSMFLERKETEDLKSRVKGFKAKIIKQGEEQISGLKFMATHWVFSYLCFKGIKQKLSTEFHEETLLIQIIDELSKVPDEVYSAFDSKTKEKFLEDINEYMKEGNADLSLEDSKVIHPVIRKRYENKFNYFAIRFLDEYLSSTSLKFQVHVGNYVHDRRVKHINGTGFQTERIVKDRIKVFGRLSNISNLKADYIKEQLELPNDSNGWEIFPNPSYIFIDNNVPIHVLADEATKKGIELFKDKRRKEQPEELQKRKGKISKYNIVSMIYKEAKGKDKLRIDEPLALLSLNEIPALLYQILEKGATPKDIELIIKNKLTERFEKIKNYDPETPAPASQISKRLRNNTTAKGQEALNAEKLSLLIEREIENTETKLSSIEEKRLKAKKEQRRNTPQRSIFSNSDLGRIAAWLADDIKRFMPAEQRKNWKGYQHSQLQQSLAYFEKRPQEAFLLLKEGWDTSDGSSYWNNWVMNSFLENNHFEKFYKNYLMKRVKYFSELAGNIKQHTHNTKFLRKFIKQQMPADLFPKRHYILKDLETEKNKVLSKPLVFSRGLFDNNPTFIKGVKVTENPELFAEWYSYGYKTEHVFQHFYGWERDYNELLDSELQKGNSFAKNSIYYNRESQLDLIKLKQDLKIKKIKIQDLFLKRIAEKLFENVFNYPTTLSLDEFYLTQEERAEKERIALAQSLREEGDNSPNIIKDDFIWSKTIAFRSKQIYEPAIKLKDIGKFNRFVLDDEESKASKLLSYDKNKIWNKEQLERELSIGENSYEVIRREKLFKEIQNLELQILSNWSWDGINHPREFEMEDQKNTRHPNFKMYLVNGILRKNINLYKEDEDFWLESLKENDFKTLPSEVLETKSEMVQLLFLVILIRNQFAHNQLPEIQFYNFIRKNYPEIQNNTVAELYLNLIKLAVQKLKDNS

SEQ ID NO: 71 - protein, 1156 aa, Chryseobacterium carnipullorum
MNTRVTGMGVSYDHTKKEDKHFFGGFLNLAQDNITAVIKAFCIKFDKNPMSSVQFAESCFTDKDSDTDFQNKVRYVRTHLPVIGYLNYGGDRNTFRQKLSTLLKAVDSLRNFYTHYYHSPLALSTELFELLDTVFASVAVEVKQHKMKDDKTRQLLSKSLAEELDIRYKQQLERLKELKEQGKNIDLRDEAGIRNGVLNAAFNHLIYKEGEIAKPTLSYSSFYYGADSAENGITISQSGLLFLLSMFLGKKEIEDLKSRIRGFKAKIVRDGEENISGLKFMATHWIFSYLSFKGMKQRLSTDFHEETLLIQIIDELSKVPDEVYHDFDTATREKFVEDINEYIREGNEDFSLGDSTIIHPVIRKRYENKFNYFAVRFLDEFIKFPSLRFQVHLGNFVHDRRIKDIHGTGFQTERVVKDRIKVFGKLSEISSLKTEYIEKELDLDSDTGWEIFPNPSYVFIDNNIPIYISTNKTFKNGSSEFIKLRRKEKPEEMKMRGEDKKEKRDIASMIGNAGSLNSKTPLAMLSLNEMPALLYEILVKKTTPEEIELIIKEKLDSHFENIKNYDPEKPLPASQISKRLRNNTTDKGKKVINPEKLIHLINKEIDATEAKFALLAKNRKELKEKFRGKPLRQTIFSNMELGREATWLADDIKRFMPDILRKNWKGYQHNQLQQSLAFFNSRPKEAFTILQDGWDFADGSSFWNGWIINSFVKNRSFEYFYEAYFEGRKEYFSSLAENIKQHTSNHRNLRRFIDQQMPKGLFENRHYLLENLETEKNKILSKPLVFPRGLFDTKPTFIKGIKVDEQPELFAEWYQYGYSTEHVFQNFYGWERDYNDLLESELEKDNDFSKNSIHYSRTSQLELIKLKQDLKIKKIKIQDLFLKLIAGHIFENIFKYPASFSLDELYLTQEERLNKEQEALIQSQRKEGDHSDNIIKDNFIGSKTVTYESKQISEPNVKLKDIGKFNRFLLDDKVKTLLSYNEDKVWNKNDLDLELSIGENSYEVIRREKLFKKIQNFELQTLTDWPWNGTDHPEEFGTTDNKGVNHPNFKMYVVNGILRKHTDWFKEGEDNWLENLNETHFKNLSFQELETKSKSIQTAFLIIMIRNQFAHNQLPAVQFFEFIQKKYPEIQGSTTSELYLNFINLAVVELLELLEK

SEQ ID NO: 72 - protein, 1036 aa, Chryseobacterium ureilyticum
METQILGNGISYDHTKTEDKHFFGGFLNTAQNNIDLLIKAYISKFESSPRKLNSVQFPDVCFKKNDSDADFQHKLQFIRKHLPVIQYLKYGGNREVLKEKFRLLLQAVDSLRNFYTHFYHKPIQLPNELLTLLDTIFGEIGNEVRQNKMKDDKTRHLLKKNLSEELDFRYQEQLERLRKLKSEGKKVDLRDTEAIRNGVLNAAFNHLIFKDAEDFKPTVSYSSYYYDSDTAENGISISQSGLLFLLSMFLGRREMEDLKSRVRGFKARIIKHEEQHVSGLKFMATHWVFSEFCFKGIKTRLNADYHEETLLIQLIDELSKVPDELYRSFDVATRERFIEDINEYIRDGKEDKSLIESKIVHPVIRKRYESKFNYFAIRFLDEFVNFPTLRFQVHAGNYVHDRRIKSIEGTGFKTERLVKDRIKVFGKLSTISSLKAEYLAKAVNITDDTGWELLPHPSYVFIDNNIPIHLTVDPSFKNGVKEYQEKRKLQKPEEMKNRQGGDKMHKPAISSKIGKSKDINPESPVALLSMNEIPALLYEILVKKASPEEVEAKIRQKLTAVFERIRDYDPKVPLPASQVSKRLRNNTDTLSYNKEKLVELANKEVEQTERKLALITKNRRECREKVKGKFKRQKVFKNAELGTEATWLANDIKRFMPEEQKKNWKGYQHSQLQQSLAFFESRPGEARSLLQAGWDFSDGSSFWNGWVMNSFARDNTFDGFYESYLNGRMKYFLRLADNIAQQSSTNKLISNFIKQQMPKGLFDRRLYMLEDLATEKNKILSKPLIFPRGIFDDKPTFKKGVQVSEEPEAFADWYSYGYDVKHKFQEFYAWDRDYEELLREELEKDTAFTKNSIHYSRESQIELLAKKQDLKVKKVRIQDLYLKLMAEFLFENVFGHELALPLDQFYLTQEERLKQEQEAIVQSQRPKGDDSPNIVKENFIWSKTIPFKSGRVFEPNVKLKDIGKFRNLLTDEKVDILLSYNNTEIGKQVIENELIIGAGSYEFIRREQLFKEIQQMKRLSLRSVRGMGVPIRLNLK

SEQ ID NO: 73 - protein, 1127 aa, Prevotella buccae
MQKQDKLFVDRKKNAIFAFPKYITIMENQEKPEPIYYELTDKHFWAAFLNLARHNVYTTINHINRRLEIAELKDDGYMMDIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAQQNQPEVWRKLVKDLDYFEASQEPYIPKTAPHYHLENEKIGIKFCSTHNNLFPSLKTEKTCNGRSKFNLGTQFTAEAFLSVHELLPMMFYYLLLTKDYSRKESADKVEGIIRKEISNIYAIYDAFANGEINSIADLTCRLQKTNILQGHLPKQMISILEGRQKDMEKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDHELIKYQTTRISIFEMTLGLEKKLINKYPTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 74 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHNLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 75 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 76 - protein, 1125 aa, Prevotella pallens; identical to SEQ ID NO: 58

SEQ ID NO: 77 - protein, 1157 aa, Myroides odoratimimus; identical to SEQ ID NO: 59

SEQ ID NO: 78 - protein, 1157 aa, Myroides odoratimimus; identical to SEQ ID NO: 60

SEQ ID NO: 79 - protein, 1127 aa, Prevotella sp.
MQKQDKLFVDRKKNAIFAFPKYITIMENQEKPEPIYYELTDKHFWAAFLNLARHNVYTTINHINRRLEIAELKDDGYMMGIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSTHNNLFPSLKREKTCNGRSKFNLGTQFTAEAFLSVHELLPMMFYYLLLTKDYSRKESADKVEGIIRKEISNIYAIYDAFANNEINSIADLTCRLQKTNILQGHLPKQMISILEGRQKDMEKEAERKIGEMIDDTQRRLDLLCKQTNQKIRIGKRNAGLLKSGKIADWLVSDMMRFQPVQKDTNNAPINNSKANSTEYRMLQHALALFGSESSRLKAYFRQMNLVGNANPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKNKTDLAYLDFLSWKKFERELRLIKNQDIVTWLMFKELFKTTTVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDYELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 80 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEINTRDELDACLADKGIRRGHLPRQMIGILSQEHKDMEEKVRKKLQEMIVDTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMICRDLMEENKVEGLDTGTLYLKDIRTDVQEQGNLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDEAVFSSIRKYDPSSPDAIEERMGLNIAHRLSEEVKQAKEMAERIIQA

SEQ ID NO: 81 - protein, 1154 aa, Paludibacter propionicigenes
MKTSANNIYFNGINSFKKIFDSKGAIAPIAEKSCRNFDIKAQNDVNKEQRIHYFAVGHTFKQLDTENLFEYVLDENLRAKRPTRFISLQQFDKEFIENIKRLISDIRNINSHYIHRFDPLKIDAVPTNIIDFLKESFELAVIQIYLKEKGINYLQFSENPHADQKLVAFLHDKFLPLDEKKTSMLQNETPQLKEYKEYRKYFKTLSKQAAIDQLLFAEKETDYIWNLFDSHPVLTISAGKYLSFYSCLFLLSMFLYKSEANQLISKIKGFKKNTTEEEKSKREIFTFFSKRFNSMDIDSEENQLVKFRDLILYLNHYPVAWNKDLELDSSNPAMTDKLKSKIIELEINRSFPLYEGNERFATFAKYQIWGKKHLGKSIEKEYINASFTDEEITAYTYETDTCPELKDAHKKLADLKAAKGLFGKRKEKNESDIKKTETSIRELQHEPNPIKDKLIQRIEKNLLTVSYGRNQDRFMDFSARFLAEINYFGQDASFKMYHFYATDEQNSELEKYELPKDKKKYDSLKFHQGKLVHFISYKEHLKRYESWDDAFVIENNAIQLKLSFDGVENTVTIQRALLIYLLEDALRNIQNNTAENAGKQLLQEYYSHNKADLSAFKQILTQQDSIEPQQKTEFKKLLPRRLLNNYSPAINHLQTPHSSLPLILEKALLAEKRYCSLVVKAKAEGNYDDFIKRNKGKQFKLQFIRKAWNLMYFRNSYLQNVQAAGHHKSFHIERDEFNDFSRYMFAFEELSQYKYYLNEMFEKKGFFENNEFKILFQSGTSLENLYEKTKQKFEIWLASNTAKTNKPDNYHLNNYEQQFSNQLFFINLSHFINYLKSTGKLQTDANGQIIYEALNNVQYLIPEYYYTDKPERSESKSGNKLYNKLKATKLEDALLYEMAMCYLKADKQIADKAKHPITKLLTSDVEFNITNKEGIQLYHLLVPFKKIDAFIGLKMHKEQQDKKHPTSFLANIVNYLELVKNDKDIRKTYEAFSTNPVKRTLTYDDLAKIDGHLISKSIKFTNVTLELERYFIFKESLIVKKGNNIDFKYIKGLRNYYNNEKKKNEGIRNKAFHFGIPDSKSYDQLIRDAEVMFIANEVKPTHATKYTDLNKQLHTVCDKLMETVHNDYFSKEGDGKKKREAAGQKYFENIISAK

SEQ ID NO: 82 - protein, 1119 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKNKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEEDTDGAEEDPFKNTLVRHQDRFPYFALRYFDLKKVFTSLRFQIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRFTAEAFLSAHELMPMMFYYFLLREKYSEEASAERVQGRIKRVIEDVYAVYDAFARDEINTRDELDACLADKGIRRGHLPRQMIGILSQEHKDMEEKIRKKLQEMMADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDWVQPFYNYPFNVGNSLKPKKGRFLSKEKRAEEWESGKERFRLAKLKKEILEAKEHPYLDFKSWQKFERELRLVKNQDIITWMICGDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRCPHLPDKNFRKMLESWSDPLLDKWPDLHRKVRLLIAVRNAFSHNQYPMYDEAVFSSIRKYDPSFPDAIEERMGLNIAHRLSEEVKQAKETVERIIQA

SEQ ID NO: 83 - protein, 1179 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNAIQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLNTESTFLENGLIGLPPKILKKELSKRFKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKRNDSSLWNKVIHLSLQNNRITANPKLKDIGKYKRALQDEKIATLLTYDDRTWTYALQKPEKENENDYKELHYTALNMELQEYEKVRSKELLKQVQELEKQILEEYTDFLSTQIHPADFEREGNPNFKKYLAHSILENEDDLDKLPEKVEAMRELDETITNPIIKKAIVLIIIRNKMAHNQYPPKFIYDLANRFVPKKEEEYFATYFNRVFETITKELWENKEKKDKTQV

SEQ ID NO: 84 - protein, 1145 aa, Psychroflexus torquis
MESIIGLGLSFNPYKTADKHYFGSFLNLVENNLNAVFAEFKERISYKAKDENISSLIEKHFIDNMSIVDYEKKISILNGYLPIIDFLDDELENNLNTRVKNFKKNFIILAEAIEKLRDYYTHFYHDPITFEDNKEPLLELLDEVLLKTILDVKKKYLKTDKTKEILKDSLREEMDLLVIRKTDELREKKKTNPKIQHTDSSQIKNSIFNDAFQGLLYEDKGNNKKTQVSHRAKTRLNPKDIHKQEERDFEIPLSTSGLVFLMSLFLSKKEIEDFKSNIKGFKGKVVKDENHNSLKYMATHRVYSILAFKGLKYRIKTDTFSKETLMMQMIDELSKVPDCVYQNLSETKQKDFIEDWNEYFKDNEENTENLENSRVVHPVIRKRYEDKFNYFAIRFLDEFANFKTLKFQVFMGYYIHDQRTKTIGTTNITTERTVKEKINVFGKLSKMDNLKKHFFSQLSDDENTDWEFFPNPSYNFLTQADNSPANNIPIYLELKNQQIIKEKDAIKAEVNQTQNRNPNKPSKRDLLNKILKTYEDFHQGDPTAILSLNEIPALLHLFLVKPNNKTGQQIENIIRIKIEKQFKAINHPSKNNKGIPKSLFADTNVRVNAIKLKKDLEAELDMLNKKHIAFKENQKASSNYDKLLKEHQFTPKNKRPELRKYVFYKSEKGEEATWLANDIKRFMPKDFKTKWKGCQHSELQRKLAFYDRHTKQDIKELLSGCEFDHSLLDINAYFQKDNFEDFFSKYLENRIETLEGVLKKLHDFKNEPTPLKGVFKNCFKFLKRQNYVTESPEIIKKRILAKPTFLPRGVFDERPTMKKGKNPLKDKNEFAEWFVEYLENKDYQKFYNAEEYRMRDADFKKNAVIKKQKLKDFYTLQMVNYLLKEVFGKDEMNLQLSELFQTRQERLKLQGIAKKQMNKETGDSSENTRNQTYIWNKDVPVSFFNGKVTIDKVKLKNIGKYKRYERDERVKTFIGYEVDEKWMMYLPHNWKDRYSVKPINVIDLQIQEYEEIRSHELLKEIQNLEQYIYDHTTDKNILLQDGNPNFKMYVLNGLLIGIKQVNIPDFIVLKQNTNFDKIDFTGIASCSELEKKTIILIAIRNKFAHNQLPNKMIYDLANEFLKIEKNETYANYYLKVLKKMISDLA

SEQ ID NO: 85 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRRLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLKVLREYCEIVKSQI

SEQ ID NO: 86 - protein, 1139 aa, Prevotella pleuritidis
MENDKRLEESACYTLNDKHFWAAFLNLARHNVYITVNHINKTLELKNKKNQEIIIDNDQDILAIKTHWAKVNGDLNKTDRLRELMIKHFPFLEAAIYSNNKEDKEEVKEEKQAKAQSFKSLKDCLFLFLEKLQEARNYYSHYKYSESSKEPEFEEGLLEKMYNTFDASIRLVKEDYQYNKDIDPEKDFKHLERKEDFNYLFTDKDNKGKITKNGLLFFVSLFLEKKDAIWMQQKFRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGGKKEDRHLTHKLYGFERIQEFTKQNRPDKWQAIIKDLDTYETSNERYISETTPHYHLENQKIGIRFRNDNNDIWPSLKTNGEKNEKSKYNLDKPYQAEAFLSVHELLPMMFYYLLLKMENTDNDKEDNEVGTKKKGNKNNKQEKHKIEEIIENKIKDIYALYDAFTNGEINSIDELAEQREGKDIEIGHLPKQLIVILKNKSKDMAEKANRKQKEMIKDTKKRLATLDKQVKGEIEDGGRNIRLLKSGEIARWLVNDMMRFQPVQKDNEGKPLNNSKANSTEYQMLQRSLALYNKEEKPTRYFRQVNLIKSSNPHPFLEDTKWEECYNILSFYRNYLKAKIKFLNKLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDILTWLLCTKLIDKLKIDELNIEELQKLRLKDIDTDTAKKEKNNILNRVMPMRLPVTVYEIDKSFNIVKDKPLHTVYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVGLLVAVRNAFSHNQYPMYNSEVFKGMKLLSLSSDIPEKEGLGIAKQLKDKIKETIERIIEIEKEIRN

SEQ ID NO: 87 - protein, 1135 aa, Porphyromonas gingivalis; identical to SEQ ID NO: 65

SEQ ID NO: 88 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTNENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 89 - protein, 1135 aa, Porphyromonas gingivalis; identical to SEQ ID NO: 66

SEQ ID NO: 90 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKIMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEIPLIYRDVSAKVGSIEGSSAKDLPEGSSLVDSLWKKYEMIIRKILPILDPENRFFGKLLNNMSQPINDL

SEQ ID NO: 91 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 92 - protein, 1133 aa, Prevotella falsenii
MKNDNNSTKSTDYTLGDKHFWAAFLNLARHNVYITVNHINKVLELKNKKDQEIIIDNDQDILAIKTLWGKVDTDINKKDRLRELIMKHFPFLEAATYQQSSTNNTKQKEEEQAKAQSFESLKDCLFLFLEKLREARNYYSHYKHSKSLEEPKLEEKLLENMYNIFDTNVQLVIKDYEHNKDINPEEDFKHLGRAEGEFNYYFTRNKKGNITESGLLFFVSLFLEKKDAIWAQTKIKGFKDNRENKQKMTHEVFCRSRMLLPKLRLESTQTQDWILLDMLNELIRCPKSLYKRLQGEKREKFRVPFDPADEDYDAEQEPFKNTLVRHQDRFPYFALRYFDYNEIFTNLRFQIDLGTYHFSIYKKQIGDKKEDRHLTHKLYGFERIQEFAKENRPDEWKALVKDLDTFEESNEPYISETTPHYHLENQKIGIRNKNKKKKKTIWPSLETKTTVNERSKYNLGKSFKAEAFLSVHELLPMMFYYLLLNKEEPNNGKINASKVEGIIEKKIRDIYKLYGAFANEEINNEEELKEYCEGKDIAIRHLPKQMIAILKNEYKDMAKKAEDKQKKMIKDTKKRLAALDKQVKGEVEDGGRNIKPLKSGRIASWLVNDMMRFQPVQRDRDGYPLNNSKANSTEYQLLQRTLALFGSERERLAPYFRQMNLIGKDNPHPFLKDTKWKEHNNILSFYRSYLEAKKNFLGSLKPEDWKKNQYFLKLKEPKTNRETLVQGWKNGFNLPRGIFTEPIREWFIRHQNESEEYKKVKDFDRIGLVAKVIPLFFKEDYQKEIEDYVQPFYGYPFNVGNIHNSQEGTFLNKKEREELWKGNKTKFKDYKTKEKNKEKTNKDKFKKKTDEEKEEFRSYLDFQSWKKFERELRLVRNQDIVTWLLCMELIDKLKIDELNIEELQKLRLKDIDTDTAKKEKNNILNRIMPMELPVTVYETDDSNNIIKDKPLHTIYIKEAETKLLKQGNFKALVKDRRLNGLFSFVETSSEAELKSKPISKSLVEYELGEYQRARVEIIKDMLRLEETLIGNDEKLPTNKFRQMLDKWLEHKKETDDTDLKNDVKLLTEVRNAFSHNQYPMRDRIAFANIKPFSLSSANTSNEEGLGIAKKLKDKTKETIDRIIEIEEQTATKR

SEQ ID NO: 93 - protein, 1116 aa, Prevotella pleuritidis
MENDKRLEESTCYTLNDKHFWAAFLNLARHNVYITINHINKLLEIRQIDNDEKVLDIKALWQKVDKDINQKARLRELMIKHFPFLEAAIYSNNKEDKEEVKEEKQAKAQSFKSLKDCLFLFLEKLQEARNYYSHYKSSESSKEPEFEEGLLEKMYNTFGVSIRLVKEDYQYNKDIDPEKDFKHLERKEDFNYLFTDKDNKGKITKNGLLFFVSLFLEKKDAIWMQQKLRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGDNKEDRHLTHKLYGFERIQEFAKQKRPNEWQALVKDLDIYETSNEQYISETTPHYHLENQKIGIRFKNKKDKIWPSLETNGKENEKSKYNLDKSFQAEAFLSIHELLPMMFYDLLLKKEEPNNDEKNASIVEGFIKKEIKRMYAIYDAFANEEINSKEGLEEYCKNKGFQERHLPKQMIAILTNKSKNMAEKAKRKQKEMIKDTKKRLATLDKQVKGEIEDGGRNIRLLKSGEIARWLVNDMMRFQSVQKDKEGKPLNNSKANSTEYQMLQRSLALYNKEQKPTPYFIQVNLIKSSNPHPFLEETKWEECNNILSFYRSYLEAKKNFLESLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDIVTWLLCTELIDKLKIDELNIEELQKLRLKDIDTDTAKKEKNNILNRIMPMQLPVTVYEIDKSFNIVKDKPLHTIYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVDLLVAIRNAFSHNQYPMYNSEVFKGMKLLSLSSDIPEKEGLGIAKQLKDKIKETIERIIEIEKEIRN

SEQ ID NO: 94 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPIDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHRKVRLLIAVRNAFSHNQYPMYDEAVFSSIRKYDPSSPDAIEERMGLNIAHRLSEEVKQAKEMAERIIQV

SEQ ID NO: 95 - protein, 1175 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKNMEEKVRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHDTRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRTNVQEQGSLNVLNHVKPMRLPVVVYRADSRGHVHKEEAPLATVYIEERDTKLLKQGNFKSFVKDRRLNGLFSFVDTGGLAMEQYPISKLRVEYELAKYQTARVCAFEQTLELEESLLTRYPHLPDKNFRKMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 96 - protein, 1119 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKVIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTRDELDACLADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKTDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 97 - protein, 1119 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIKDVYAIYDAFARDEINTLKELDACSADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKNDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRYPHLPDENFREMLESWSDPLLGKWPDLHGKVRLLIAVRNAFSHNQYPMYDEAVFSSIRKYDPSSPDAIEERMGLNIAHRLSEEVKQAKETVERIIQA

SEQ ID NO: 98 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 99 - protein, 1119 aa, Porphyromonas gulae
MTEQSERPYNGTYYTLEDKHFWAAFLNLARHNAYITLTHIDRQLAYSKADITNDEDILFFKGQWKNLDNDLERKSRLRSLILKHFSFLEGAAYGKKFFESKSSGNKSSKNKELTKKEKEELQANALSLDNLKSILFDFLQKLKDFRNYYSHYRHSGSSELPLFDGNMLQRLYNVFDVSVQRVKRDHEHNDEVDPHYHFNHLVRKGKKDRYGHNDNPSFKHHFVDGEGMVTEAGLLFFVSLFLEKRDAIWMQKKIRGFKGGTEPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLTKWPELHGKVRLLIAVRNAFSHNQYPMYDEAVFSSIWKYDPSSPDAIEERMGLNIAHRLSEEVKQAKETIERIIQA

SEQ ID NO: 100 - protein, 1174 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYLETGDKPYISQTTPHYHIEKGKIGLRFVPEGQHLWPSPEVGTTRTGRSKCAQDKRLTAEAFLSVHELMPMMFYYFLLREKYSEEVSAEKVQGRIKRVIEDVYAIYDAFARDEINTLKELDTCLADKGIRRGHLPKQMITILSQERKDMKEKIRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKDEFHLPRGIFTEAVRDCLIEMGYDEVGSYREVGFMAKAVPLYFERACEDRVQPFYDSPFNVGNSLKPKKGRFLSKEDRAEEWERGMERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEAPLATVYIEERNTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 101 - protein, 1135 aa, Porphyromonas gulae
MNTVPATENKGQSRTVEDDPQYFGLYLNLARENLIEVESHVRIKFGKKKLNEESLKQSLLCDHLLSIDRWTKVYGHSRRYLPFLHCFDPDSGIEKDHDSKTGVDPDSAQRLIRELYSLLDFLRNDFSHNRLDGTTFEHLKVSPDISSFITGAYTFACERAQSRFADFFKPDDFLLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 102 - protein, 1218 aa, Capnocytophaga cynodegmi
MENKTSLGNNIYYNPFKPQDKSYFAGYLNAAMENIDSVFRELGKRLKGKEYTSENFFDAIFKENISLVEYERYVKLLSDYFPMARLLDKKEVPIKERKENFKKNFRGIIKAVRDLRNFYTHKEHGEVEITDEIFGVLDEMLKSTVLTVKKKKIKTDKTKEILKKSIEKQLDILCQKKLEYLKDTARKIEEKRRNQRERGEKKLVPRFEYSDRRDDLIAAIYNDAFDVYIDKKKDSLKESSKTKYNTESYPQQEEGDLKIPISKNGVVFLLSLFLSKQEVHAFKSKIAGFKATVIDEATVSHRKNSICFMATHEIFSHLAYKKLKRKVRTAEINYSEAENAEQLSIYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKEHLISDRRIKEKITVFGRLSELEHKKALFIKNTETNEDRKHYWEVFPNPNYDFPKENISVNDKDFPIAGSILDREKQPTAGKIGIKVNLLNQKYISEVDKAVKAHQLKQRNNKPSIQNIIEEIVPINGSNPKEIIVFGGQPTAYLSMNDIHSILYEFFDKWEKKKEKLEKKGEKELRKEIGKELEEKIVGKIQTQIQQIIDKDINAKILKPYQDDDSTAIDKEKLIKDLKQEQKILQKLKNEQTAREKEYQECIAYQEESRKIKRSDKSRQKYLRNQLKRKYPEVPTRKEILYYQEKGKVAVWLANDIKRFMPTDFKNEWKGEQHSLLQKSLAYYEQCKEELKNLLPQQKVFKHLPFELGGHFQQKYLYQFYTRYLDKRLEHISGLVQQAENFKNENKVFKKVENECFKFLKKQNYTHKGLDAQAQSVLGYPIFLERGFMDEKPTIIKGKTFKGNESLFTDWFRYYKEYQNFQTFYDTENYPLVELEKKQADRKRETKIYQQKKNDVFTLLMAKHIFKSVFKQDSIDRFSLEDLYQSREERLENQEKAKQTGERNTNYIWNKTVDLNLCDGKVTVENVKLKNVGNFIKYEYDQRVQTFLKYEENIKWQAFLIKESKEEENYPYIVEREIEQYEKVRREELLKEVHLIEEYILEKVKDKEILKKGDNQNFKYYILNGLLKQLKNEDVESYKVFNLNTKPEDVNINQLKQEATDLEQKAFVLTYIRNKFAHNQLPKKEFWDYCQEKYGKIEKEKTYAEYFAEVFKREKEALMK

SEQ ID NO: 103 - protein, 1090 aa, Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPLSGMISKYYTVALRNTKERYGYKTEDLAFIQDNIKKITKDAYGKRKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSTDRFVPLLLQYIDYGKLFDHIRFHVNMGKLRYLLKADKTCIDGQTRVRVIEQPLNGFGRLEEAETMRKQENGTFGNSGIRIRDFENVKRDDANPANYPYIVDTYTHYILENNKVEMFISDKGSSAPLLPLIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVDFYERYLIERKFYLTGLCNEIKRGNRVDVPFIRRDQNKWKTPAMKTLGRIYSEDLPVELPRQMFDNEIKSHLKSLPQMEGIDFNNANVTYLIAEYMKRVLNDDFQTFYQWKRNYHYMDMLKGEYDRKGSLQHCFTSVEEREGLWKERASRTERYRKLASNKIRSNRQMRNASSEEIETILDKRLSNCRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGIVEIKALPEIAMSIKKAFGEYAIMK

SEQ ID NO: 104 - protein, 1090 aa, Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDQASHYKTYDEKLIDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKQPKDRIHSEKSNKSVAMDMLNEIKRCPNELFETLSAEKQSRFRIISNDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVDTYTHYILENNKVEMFISDEETPAPLLPVIEDDRYVVKTIPSCRMSTLEIPAMAFHMFLFGSKKTEKLIVDVHNRYKRLFKAMQKEEVTAENIASFGIAESDLPQKIIDLISGNAHGKDVDAFIRLTVDDMLADTERRIKRFKDDRKSIRSADNKMGKRGFKQISTGKLADFLAKDIVLFQPSVNDGENKITGLNYRIMQSAIAVYNSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYDEDLPVELPRQMFDNEIKSHLKSLPQMEGIDFNNANVTYLIAEYMKRVLNDDFQTFYQWKRNYRYMDMLRGEYDRKGSLQSCFTSVEEREGLWKERASRTERYRKLASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDTVSKEDIMEEFKKYDQCRPEISSIVFNLEKWAFDTYPELSARVDREEKVDFKSILKILLNNKNINKEQSDILRKIRNAFDHNNYPDKGVVEIRALPEIAMSIKKAFGEYAIMK

SEQ ID NO: 105 - protein, 1090 aa, Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPFSGMISKYYTVALRNTKERYGYKAEDLAFIQDNRYKFTKDAYGKRKSQVNTGSFLSLQDYNGDTTKKLHLSGVGIALLICLFLDKQYINLFLSRLPIFSSYNAQSEERRIIIRSFGINSIKQPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVETYTHYILENNKVEMFISDEENPTPLLPVIEDDRYVVKTIPSCRMSTLEIPAMAFHMFLFGSEKTEKLIIDVHDRYKRLFQAMQKEEVTAENIASFGIAESDLPQKIMDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYSEDLPVELPRQMFDNEIKSHLKSLPQMEGIDFNNANVTYLIAEYMKRVLNDDFQTFYQWKRNYRYMDMLRGEYDRKGSLQHCFTSIEEREGLWKERASRTERYRKLASNKIRSNRQMRNASSEEIETILDKRLSNCRNEYQKSEKIIRRYRVQDALLFLLAKKTLTELADFDGERFKLKEIMPDAEKGILSEIMPMSFTFEKGGKIYTITSGGMKLKNYGDFFVLASDKRIGNLLELVGSNTVSKEDIMEEFKKYDQCRPEISSIVFNLEKWAFDTYPELPARVDRKEKVDFWSILDVLSNNKDINNEQSYILRKIRNAFDHNNYPDKGIVEIKALPEIAMSIKKAFGEYAIMK

SEQ ID NO: 106 - protein, 1131 aa, Phaeodactylibacter xiamenensis
MTNTPKRRTLHRHPSYFGAFLNIARHNAFMIMEHLSTKYDMEDKNTLDEAQLPNAKLFGCLKKRYGKPDVTEGVSRDLRRYFPFLNYPLFLHLEKQQNAEQAATYDINPEDIEFTLKGFFRLLNQMRNNYSHYISNTDYGKFDKLPVQDIYEAAIFRLLDRGKHTKRFDVFESKHTRHLESNNSEYRPRSLANSPDHENTVAFVTCLFLERKYAFPFLSRLDCFRSTNDAAEGDPLIRKASHECYTMFCCRLPQPKLESSDILLDMVNELGRCPSALYNLLSEEDQARFHIKREEITGFEEDPDEELEQEIVLKRHSDRFPYFALRYFDDTEAFQTLRFDVYLGRWRTKPVYKKRIYGQERDRVLTQSIRTFTRLSRLLPIYENVKHDAVRQNEEDGKLVNPDVTSQFHKSWIQIESDDRAFLSDRIEHFSPHYNFGDQVIGLKFINPDRYAAIQNVFPKLPGEEKKDKDAKLVNETADAIISTHEIRSLFLYHYLSKKPISAGDERRFIQVDTETFIKQYIDTIKLFFEDIKSGELQPIADPPNYQKNEPLPYVRGDKEKTQEERAQYRERQKEIKERRKELNTLLQNRYGLSIQYIPSRLREYLLGYKKVPYEKLALQKLRAQRKEVKKRIKDIEKMRTPRVGEQATWLAEDIVFLTPPKMHTPERKTTKHPQKLNNDQFRIMQSSLAYFSVNKKAIKKFFQKETGIGLSNRETSHPFLYRIDVGRCRGILDFYTGYLKYKMDWLDDAIKKVDNRKHGKKEAKKYEKYLPSSIQHKTPLELDYTRLPVYLPRGLFKKAIVKALAAHADFQVEPEEDNVIFCLDQLLDGDTQDFYNWQRYYRSALTEKETDNQLVLAHPYAEQILGTIKTLEGKQKNNKLGNKAKQKIKDELIDLKRAKRRLLDREQYLRAVQAEDRALWLMIQERQKQKAEHEEIAFDQLDLKNITKILTESIDARLRIPDTKVDITDKLPLRRYGDLRRVAKDRRLVNLASYYHVAGLSEIPYDLVKKELEEYDRRRVAFFEHVYQFEKEVYDRYAAELRNENPKGESTYFSHWEYVAVAVKHSADTHFNELFKEKVMQLRNKFHHNEFPYFDWLLPEVEKASAALYADRVFDVAEGYYQKMRKLMRQ

SEQ ID NO: 107 - protein, 1155 aa, Flavobacterium sp.
MDNNITVEKTELGLGITYNHDKVEDKHYFGGFFNLAQNNIDLVAQEFKKRLLIQGKDSINIFANYFSDQCSITNLERGIKILAEYFPVVSYIDLDEKNKSKSIREHLILLLETINNLRNYYTHYYHKKIIIDGSLFPLLDTILLKVVLEIKKKKLKEDKTKQLLKKGLEKEMTILFNLMKAEQKEKKIKGWNIDENIKGAVLNRAFSHLLYNDELSDYRKSKYNTEDETLKDTLTESGILFLLSFFLNKKEQEQLKANIKGYKGKIASIPDEEITLKNNSLRNMATHWTYSHLTYKGLKHRIKTDHEKETLLVNMVDYLSKVPHEIYQNLSEQNKSLFLEDINEYMRDNEENHDSSEASRVIHPVIRKRYENKFAYFAIRFLDEFAEFPTLRFMVNVGNYIHDNRKKDIGGTSLITNRTIKQQINVFGNLTEIHKKKNDYFEKEENKEKTLEWELFPNPSYHFQKENIPIFIDLEKSKETNDLAKEYAKEKKKIFGSSRKKQQNTAKKNRETIINLVFDKYKTSDRKTVTFEQPTALLSFNELNSFLYAFLVENKTGKELEKIIIEKIANQYQILKNCSSTVDKTNDNIPKSIKKIVNTTTDSFYFEGKKIDIEKLEKDITIEIEKTNEKLETIKENEESAQNYKRNERNTQKRKLYRKYVFFTNEIGIEATWITNDILRFLDNKENWKGYQHSELQKFISQYDNYKKEALGLLESEWNLESDAFFGQNLKRMFQSNSTFETFYKKYLDNRKNTLETYLSAIENLKTMTDVRPKVLKKKWTELFRFFDKKIYLLSTIETKINELITKPINLSRGIFEEKPTFINGKNPNKENNQHLFANWFIYAKKQTILQDFYNLPLEQPKAITNLKKHKYKLERSINNLKIEDIYIKQMVDFLYQKLFEQSFIGSLQDLYTSKEKREIEKGKAKNEQTPDESFIWKKQVEINTHNGRIIAKTKIKDIGKFKNLLTDNKIAHLISYDDRIWDFSLNNDGDITKKLYSINTELESYETIRREKLLKQIQQFEQFLLEQETEYSAERKHPEKFEKDCNPNFKKYIIEGVLNKIIPNHEIEEIEILKSKEDVFKINFSDILILNNDNIKKGYLLIMIRNKFAHNQLIDKNLFNFSLQLYSKNENENFSEYLNKVCQNIIQEFKEKLK

SEQ ID NO: 108 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 109 - protein, 1145 aa, Chryseobacterium sp.
METQTIGHGIAYDHSKIQDKHFFGGFLNLAENNIKAVLKAFSEKFNVGNVDVKQFADVSLKDNLPDNDFQKRVSFLKMYFPVVDFINIPNNRAKFRSDLTTLFKSVDQLRNFYTHYYHKPLDFDASLFILLDDIFARTAKEVRDQKMKDDKTRQLLSKSLSEELQKGYELQLERLKELNRLGKKVNIHDQLGIKNGVLNNAFNHLIYKDGESFKTKLTYSSALTSFESAENGIEISQSGLLFLLSMFLKRKEIEDLKNRNKGFKAKVVIDEDGKVNGLKFMATHWVFSYLCFKGLKSKLSTEFHEETLLIQIIDELSKVPDELYCAFDKETRDKFIEDINEYVKEGHQDFSLEDAKVIHPVIRKRYENKFNYFAIRFLDEFVKFPSLRFQVHVGNYVHDRRIKNIDGTTFETERVVKDRIKVFGRLSEISSYKAQYLSSVSDKHDETGWEIFPNPSYVFINNNIPIHISVDTSFKKEIADFKKLRRAQVPDELKIRGAEKKRKFEITQMIGSKSVLNQEEPIALLSLNEIPALLYEILINGKEPAEIERIIKDKLNERQDVIKNYNPENWLPASQISRRLRSNKGERIINTDKLLQLVTKELLVTEQKLKIISDNREALKQKKEGKYIRKFIFTNSELGREAIWLADDIKRFMPADVRKEWKGYQHSQLQQSLAFYNSRPKEALAILESSWNLKDEKIIWNEWILKSFTQNKFFDAFYNEYLKGRKKYFAFLSEHIVQYTSNAKNLQKFIKQQMPKDLFEKRHYIIEDLQTEKNKILSKPFIFPRGIFDKKPTFIKGVKVEDSPESFANWYQYGYQKDHQFQKFYDWKRDYSDVFLEHLGKPFINNGDRRTLGMEELKERIIIKQDLKIKKIKIQDLFLRLIAENLFQKVFKYSAKLPLSDFYLTQEERMEKENMAALQNVREEGDKSPNIIKDNFIWSKMIPYKKGQIIENAVKLKDIGKLNVLSLDDKVQTLLSYDDAKPWSKIALENEFSIGENSYEVIRREKLFKEIQQFESEILFRSGWDGINHPAQLEDNRNPKFKMYIVNGILRKSAGLYSQGEDIWFEYNADFNNLDADVLETKSELVQLAFLVTAIRNKFAHNQLPAKEFYFYIRAKYGFADEPSVALVYLNFTKYAINEFKKVMI

SEQ ID NO: 110 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 111 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKLLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 112 - protein, 1175 aa, Porphyromonas gingivalis
MTEQNEKPYNGTYYTLKDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPMFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTETYQQMTNEVFCRSRISLPKLKLESLRTDDWMLLDMLNELVRCPKSLYDRLREEDRACFRVPVDILSDEDDTDGAEEDPFKNTLVRHQDRFPYFALRYFDLKKVFTSLRFHIDLGTYHFAIYKKNIGEQPEDRHLTRNLYGFGRIQDFAEEHRPEEWKRLVRDLDCFETGDKPYITQTTPHYHIEKGKIGLRFVPEGQHLWPSPEVGATRTGRSKYAQDKRFTAEAFLSVHELMPMMFYYFLLREKYSEEVSAERVQGRIKRVIEDVYAVYDAFARDEINTRDELDACLADKGIRRGHLPRQMIAILSQKHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVQEQGSLNVLNHVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDENFRKMLESWSDPLLDKWPDLHRKVRLLIAVRNAFSHNQYPMYDEAVFSSIRKYDPSSPDAIEERMGLNIAHRLSEEVKQAKEMAERIIQA

SEQ ID NO: 113 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKVYDFLDDTLLDVLITIKKKKVKNDTSRELLKEKFRPELTQLKNQKREELIKKGKKLLEENLENAVFNHCLRPFLEENKTDDKQNKTVSLRKYRKSKPNEETSITLTQSGLVFLISFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLTKTISTDTSVTFENQPIDIPRLKNALQKELTLTQEKLLNVKQHEIEVDNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 114 - protein, 1119 aa, Porphyromonas gingivalis
MTEQNERPYNGTYYTLEDKHFWAAFFNLARHNAYITLTHIDRQLAYSKADITNDEDILFFKGQWKNLDNDLERKARLRSLILKHFSFLEGAAYGKKLFENKSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTEVQEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRCPHLPDKNFRKMLESWSDPLLDKWPDLQREVWLLIAVRNAFSHNQYPMYDEAVFSSIRKYDPSSPDAIEERMGLNIAHRLSEEVKQAKEMAERIIQA

SEQ ID NO: 115 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 116 - protein, 950 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQSEKMTTEVFCRSRILLPKLRLESRYDHNQMLLDMLSELSRCPKLLYEKLSEKDKKCFQVEADGFLDEIEEEQNPFKDTLIRHQDRFPYFALRYLDLNESFKSIRFQVDLGTYHYCIYDKKIGYEQEKRHLTRTLLNFGRLQDFTEINRPQEWKALTKDLDYNETSNQPFISKTTPHYHITDNKIGFRLRTSKELYPSLEVKDGANRIAKYPYNSDFVAHAFISISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVVYDAQNQPIKSSKANSTESRLIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRHLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLRVLREYCEIVKSQI

SEQ ID NO: 117 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEKISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLNSPQKDNIPTTLIKTISTDTSVTFENQPIDIPRLKNAIQKELALTQEKLLNVKQHEIEVNNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 118 - protein, 1095 aa, Riemerella anatipestifer
MEKPLPPNVYTLKHKFFWGAFLNIARHNAFITICHINEQLGLTTPPNDDKIADVVCGTWNNILNNDHDLLKKSQLTELILKHFPFLAAMCYHPPKKEGKKKGSQKEQQKEKENEAQSQAEALNPSELIKVLKTLVKQLRTLRNYYSHHSHKKPDAEKDIFKHLYKAFDASLRMVKEDYKAHFTVNLTQDFAHLNRKGKNKQDNPDFDRYRFEKDGFFTESGLLFFTNLFLDKRDAYWMLKKVSGFKASHKQSEKMTTEVFCRSRILLPKLRLESRYDHNQMLLDMLSELSRYPKLLYEKLSEEDKKRFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSKQPFISKTTPHYHITDNKIGFRLGTSKELYPSLEVKDGANRIAQYPYNSDFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIESSKANSTEFQLIQRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSKDLTLSKPIRKEIKKHGRVGFISRAITLYFREKYQDDHQSFYDLPYKLEAKASPLPKKEHYEYWQQNKPQSPTELQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYQETPIRTVYIREEQTKALKMGNFKALVKDRRLNGLFSFIKEENDTQKHPISQLRLRRELEIYQSLRVDAFKETLNLEEKLLKKHTSLSSVENKFRILLEEWKKEYAASSMVTDEHIAFIASVRNAFCHNQYPFYEEALHAPIPLFTVAQQTTEEKDGLGIAEALLRVLREYCEIVKSQI

SEQ ID NO: 119 - protein, 1149 aa, Sinomicrobium oceani
MESTTTLGLHLKYQHDLFEDKHYFGGGVNLAVQNIESIFQAFAERYGIQNPLRKNGVPAINNIFHDNISISNYKEYLKFLKQYLPVVGFLEKSNEINIFEFREDFEILINAIYKLRHFYTHYYHSPIKLEDRFYTCLNELFVAVAIQVKKHKMKSDKTRQLLNKNLHQLLQQLIEQKREKLKDKKAEGEKVSLDTKSIENAVLNDAFVHLLDKDENIRLNYSSRLSEDIITKNGITLSISGLLFLLSLFLQRKEAEDLRSRIEGFKGKGNELRFMATHWVFSYLNVKRIKHRLNTDFQKETLLIQIADELSKVPDEVYKTLDHENRSKFLEDINEYIREGNEDASLNESTVVHGVIRKRYENKFHYLVLRYLDEFVDFPSLRFQVHLGNYIHDRRDKVIDGTNFITNRVIKEPIKVFGKLSHVSKLKSDYMESLSREHKNGWDVFPNPSYNFVGHNIPIFINLRSASSKGKELYRDLMKIKSEKKKKSREEGIPMERRDGKPTKIEISNQIDRNIKDGNFKDIYPGEPLAMLSLNELPALLFELLRRPSITPQDIEDRMVEKLYERFQIIRDYKPGDGLSTSKISKKLRKADNSTRLDGKKLLRAIQTETRNAREKLHTLEENKALQKNRKRRTVYTTREQGREASWLAQDLKRFMPIASRKEWRGYHHSQLQQILAFYDQNPKQPLELLEQFWDLKEDTYVWNSWIHKSLSQHNGFVPMYEGYLKGRLGYYKKLESDIIGFLEEHKVLKRYYTQQHLNVIFRERLYFIKTETKQKLELLARPLVFPRGIFDDKPTFVQDKKVVDHPELFADWYVYSYKDDHSFQEFYHYKRDYNEIFETELSWDIDFKDNKRQLNPSEQMDLFRMKWDLKIKKIKIQDIFLKIVAEDIYLKIFGHKIPLSLSDFYISRQERLTLDEQAVAQSMRLPGDTSENQIKESNLWQTTVPYEKEQIREPKIKLKDIGKFKYFLQQQKVLNLLKYDPQHVWTKAELEEELYIGKHSYEVVRREMLLQKCHQLEKHILEQFRFDGSNHPRELEQGNHPNFKMYIVNGILTKRGELEIEAENWWLELGNSKNSLDKVEVELLTMKTIPEQKAFLLILIRNKFAHNQLPADNYFHYASNLMNLKKSDTYSLFWFTVADTIVQEFMSL

SEQ ID NO: 120 - protein, 1133 aa, Reichenbachiella agariperforans
MKTNPLIASSGEKPNYKKFNTESDKSFKKIFQNKGSIAPIAEKACKNFEIKSKSPVNRDGRLHYFSVGHAFKNIDSKNVFRYELDESQMDMKPTQFLALQKEFFDFQGALNGLLKHIRNVNSHYVHTFEKLEIQSINQKLITFLIEAFELAVIHSYLNEEELSYEAYKDDPQSGQKLVQFLCDKFYPNKEHEVEERKTILAKNKRQALEHLLFIEVTSDIDWKLFEKHKVFTISNGKYLSFHACLFLLSLFLYKSEANQLISKIKGFKRNDDNQYRSKRQIFTFFSKKFTSQDVNSEEQHLVKFRDVIQYLNHYPSAWNKHLELKSGYPQMTDKLMRYIVEAEIYRSFPDQTDNHRFLLFAIREFFGQSCLDTWTGNTPINFSNQEQKGFSYEINTSAEIKDIETKLKALVLKGPLNFKEKKEQNRLEKDLRREKKEQPTNRVKEKLLTRIQHNMLYVSYGRNQDRFMDFAARFLAETDYFGKDAKFKMYQFYTSDEQRDHLKEQKKELPKKEFEKLKYHQSKLVDYFTYAEQQARYPDWDTPFVVENNAIQIKVTLFNGAKKIVSVQRNLMLYLLEDALYSEKRENAGKGLISGYFVHHQKELKDQLDILEKETEISREQKREFKKLLPKRLLHRYSPAQINDTTEWNPMEVILEEAKAQEQRYQLLLEKAILHQTEEDFLKRNKGKQFKLRFVRKAWHLMYLKELYMNKVAEHGHHKSFHITKEEFNDFCRWMFAFDEVPKYKEYLCDYFSQKGFFNNAEFKDLIESSTSLNDLYEKTKQRFEGWSKDLTKQSDENKYLLANYESMLKDDMLYVNISHFISYLESKGKINRNAHGHIAYKALNNVPHLIEEYYYKDRLAPEEYKSHGKLYNKLKTVKLEDALLYEMAMHYLSLEPALVPKVKTKVKDILSSNIAFDIKDAAGHHLYHLLIPFHKIDSFVALINHQSQQEKDPDKTSFLAKIQPYLEKVKNSKDLKAVYHYYKDTPHTLRYEDLNMIHSHIVSQSVQFTKVALKLEEYFIAKKSITLQIARQISYSEIADLSNYFTDEVRNTAFHFDVPETAYSMILQGIESEFLDREIKPQKPKSLSELSTQQVSVCTAFLETLHNNLFDRKDDKKERLSKARERYFEQIN

SEQ ID NO: 121 - protein, 430 aa, Enterococcus italicus
MKILFSPIGNTDPWRNDRDGAMLHIVRHYQPDRVVLFFTESIWQGNQHFSGQQAFDWVKIIQSINENCQIEIKCDTIEVENDFDAYKDLFHQYLVEEKRKYPNAEIFLNVTSGTPQMETTLCLEYVTYPDKMRCIQVSTPLKTSNAKTKYAQADCQEVDLEIVNEEESQQPSRCHKIAILSFREAIVRNQIKSLLDNYDYEAALQLVASQKSFRNGKEIRKKLKELIDDIKMHRVFSYLIKQYPRNEKLQKALLHTILLEMRHQRGDIAETLIRVKSIAEYIVEQYIQKNYPYLIIYKEDKPYFNVSYSQELTESYLALMDSRNKKTNKKMTVDSLDRILGFPAYRDFLQLLEASNEMTNEMNKVNEINNLRNKVAHNLDSLNLDRDKNGRKITNAVTAVRTMLLAVFPEVQENDFHYLKQFNQSIKELL

SEQ ID NO: 122 - protein, 464 aa, Thermus thermophilus
MEDLDALWERYREAVRAGGNPQALYQEMVWPALLALWREKPRVYPFPQAFAVSVHTLGTSPEATALAILGAGAERVYVLHTPESARFLPRLRQDTGKDLYPVEIGKSDVEAIYREVKRLLEKHPEVPVALDLTSGTKAMSAGLAAAGFFFQRFYPKVRVVYVDNEDYDPELRRPRAGTEKLRILPNPHEALAEVDALFAKELYGKGEFGQAAAYFRGMVGRTGNQAYALYALLAEMYRAWRALDFGEALKAGRKLLGQLSQNVWLNHPLNARREALEAQVALLEAVDRFLKARDFALKEGVYGLARTLLHLAQEAKEEAAVLAALYAYRALELLLQERLALLGRRAEAPGLSPEEAEALRKALAELLGVLPEEVRLPAKLGLLDLLAFLRLKGDEALGRLSLAELRGLAGALKGRNSALLVHGFDVPSPKAVEGIARLAQGLLQDLEARTALGPLSPEPVPLGF

SEQ ID NO: 123 - protein, 422 aa, Staphylococcus sp.
MKVLFSPIGNSDPWSNDRDGAMLHIVRHYKPDVVVLFFTESIWNGNRNIPGRKNFDWENIVSKVSSRTKVDIKVDSIKYENDFDSYKDIFHFYINEIRTKYSDAEILLNVTSGTPQMESTLCLEYISNPHNMKCIQVSTPAPIEGPKRSFAKLETVTEDLNKVNANEKMASNRSKSINIISFREVMVRSQIKSLVNNYDYEGALNLVSDQKSFRNGKLLRKRLLELTNQIKTHEVFPEINDKYRSVALKKSLFHYLLLNMRYNRLDVAETLIRVKSIAEFILKTYIVGHWPTLIIEKDDKPYLNAEDNLSFIYKYKLLLEKRRQNLDVSRILGLPAFIDILTVLEPNSKLLKEVNAVNDINGLRNSIAHNLETLDLDKNKNYKKIMLSVEAIKNMLHISFPEIEEKDYNYFERKNKEFRELL

SEQ ID NO: 124 - protein, 337 aa, Staphylococcus haemolyticus
MKVLFSPIGNSDPWSNDRDGAMLHIVRHYKPDVVVLFFTESIWNGNRNIPGRKNFDWENIVSKVSSRTKVDIKVDSIKYENDFDSYKDIFHFYINEIRTKYSDAEILLNVTSGTPQMESTLCLEYISNPHNMKCIQVSTPAPIEGPKRSFAKLETVTEDLNKVNANEKMASNRSKSINIISFREVMVRSQIKSLVNNYDYEGALNLVSDQKSFRNGKLLRKRLLELTNQIKTHEVFPEINDKYRSVALKKSLFHYLLLNMRYNRLDVAETLIRVKSIAEFILKTYIVGHWPTLIIEKDDKPYLNAEDNLSFIYKYKLLLEKRRQNLDVSRILGLPAF

SEQ ID NO: 125 - protein, 419 aa, Pilibacter termitis
MRCLITCVGDTDPIRNLHDGGILHIARVYRPEKIILIHSERSLAKHENVVKALNGIAHYQPEILQEEHVLKNSEVFLFDKMFEQISSIVTKYRQTFSEDVEILLNLSSATPQVISAMFAINRIEEMNTQAIQVATPVKNSNEGVGHDNKEDIQDLIETNLDNQGDFENRCVEDEGVNFSQALLKRKLRQFIEEYDYCAAYQLIHKEKGIPARKILLKELECLKNDIQTQSIPEKIKKMKFPEEIKKSLNAYLLIDLKHKRGEVAEVLIRVKSFAEFVLECFFNEEQSNLIIVKEDKPYLNVQDFPKIKENLDRMSREKGYEEFRESTILSLPIYMNILKFLYPEDSNRKKLNKIQQINGLRNNVAHRLDGFDKKNLKNVNGAVKACRELLLVVFKLDEKYLNYYDDQNKLLLERLEDNH

SEQ ID NO: 126 - protein, 306 aa, Staphylococcus aureus
MESTLCLEYISNPNNMQCIQVSTPAPTEGPRRSFAKPETLIEDLNKVNDNEKVATNRSKSIDIISFREVMVRSQIKGLVDNYDYEGALNLVSNQKSFRNGKLLRKKLLALTNQIKTHEVFPEINVKYNNAALKKSLFHYLLVNMRYNRLDVAETLIRVKSIAEFILKTYLENHWTHLMIEIDGKPYLNAEDNLSFIYKYKLLLEKRKQNLDTSRILGLPAFIDMLSILEPKSKLLKEVKAVNDINGLRNSIAHNLEALNLDKNKNYKKIMLSVEAIKNMLNISFPEIDEQDYNYFEEKNKEFKKLL

SEQ ID NO: 127 - protein, 415 aa, Tetragenococcus halophilus
MQTLISCVGDTDPIRNYHDGPLLHIARGIRPEKIVIVHSERSQEKHDNIVKALHSIPDYHPEIVVDERIIKNDDIFLFDKMFEVLSKIIQEYARSEEEIILNLTSATPQIISAMFSINRISGLNVRAYQVATPSNTSNEGIKHNNQQDIQQLIESNKDNRKDYNNRLIEDKAEKFQQLLVRKTFLDLIREYDYEGAVQVISGNDLMLSKKKKGKLHHELDNLIKSIKTQNLLPEVENSEFDVSQKTILNAYLLISLQAKRELNTEVLIRVKNFAEFIVEMYLDKNYNGLIVRYDGKPYLNIEGFEDVVLKLRYSLKKAGNELNTDRYLSLPLYAEIIRIIQPDSSLLKLIDKVNGVNTFRNQVAHGFKSINMKNSRVKDLAETCWMLLLIVNDVDEKWRSYFEDKNKVFKEMVGY

SEQ ID NO: 128 - protein, 453 aa, Fusibacter sp.
MERILFSFVGMTDPIKGYHDGPLIHIVRHYRPQKVYAYFSKETGDIEREFGIYSKAVHLVDPDCIVESLFYDVVDVSDFDIFSKHIVDIFRLIEKENPLSEILVNMTSGTLQMISSTCLLVSHLNMKFRLIQVKTPEKSANRDKHLHFDPKVDPIEDYYEGENLDVLEGSPSRCHELQILSYKKTVIKSQIESLIKGYDYDAAEKYLIKNSNLFEAENYEKAISLLKHARLRINFECKEAEKIAQKLNLKKALYPIDDIKVKMIVEYYLIMNLQRQKKDMSSFVLKLSPLSDEIARYILIEKFGINISQIAIKKKDIYKFDQQRSENELPGISAYLDEKFKEMNLGVFLWDRPLNFASMISFVEYLQTYKKPLNHPEVFPELKKWQNISKIRNMTAHTLTETSEHSIATVYGDNSKKLCSRIEFVLKDIFKGKLKEEIFAIYDKINEMILEAL

SEQ ID NO: 129 - protein, 414 aa, Lactobacillus acidipiscis
MTTLFSCVGFSDPFRNGYDGPLLNIVRSKKPDKIILVFSEGTIGNQEKISAAINGIEDSYKPSIIVDPEETPDKDTPYFDKMFKILYDKIMKYFLEEENITLNLSSGTPAMESALFSINRILGLNVSAYQVKTPVNDSNENIEFNLSDGNDGESPESTVQNTSDRILSDKGEKFEQTLIKENVKQFIQEYDYLSAYELIKNDPVLSTKEELSNKLEQFVVALKYQRVFPAVKVKKYDKEKTILLNSFLIFLLQVKRGMTSEVVIRGRNLTEFICEMYLNKNYQGLIKYDEHQLPQLNESEFTEIREQLYNNRLSTFSFLSFPVYQGIFKALGESEIGKALDQLSIFNIRNQIAHNFNELSEKKVNLLLKYYSTDNSYEIVNRLLSLIKFVFNLSKEWLIFFETENKNIISLLEK

SEQ ID NO: 130 - protein, 411 aa, Lactobacillus salivarius
MTTLISCIGDTDPIRNRHDGALLHLARVFRPKKILLIYSERALLKENNILLALNSIEGYSPVIKKDERLISNSEVFIFDKMYEILNNVVLKYSRDDEDLILNLSSGTPQMKSALFTINRLNDINVRAYQVITPSHSSNEGIRHDNNLDINYLISTNLDNRKDFEKRILEDKAEKFQKTLIKRTMKDLLNNFDYESLYDLSMRHRVLSKSKMKKIISLLQDLTEAVKYQKLLKVVNQTNYCEKEKKLINSYLIILLQVNRELVSEVLIRSKNIGEYACELYLEKNYPDLIFWKENRPYLNSENYPNIEDKLLNNEDIHYRKEQYLNIHLYIKILEELNGNEELIESLNKLSGYNQQRNKVAHGLSEISASQVNVRKIVNLCYQIVSECVDLTEDWSKFYDQFNNKISIMLDE

SEQ ID NO: 131 - RNA, 25 nt, Artificial Sequence
  Synthetic
gggaacaaagcugaaguacuuaccc

SEQ ID NO: 132 - DNA, 18 bp, Artificial Sequence
  Synthetic
gggtagggcgggttggga

SEQ ID NO: 133 - RNA, 12 nt, Artificial Sequence
  Synthetic
ucucguacguuc

SEQ ID NO: 134 - RNA, 24 nt, Artificial Sequence
  Synthetic
ucucguacguucucucguacguuc

SEQ ID NO: 135 - DNA, 10 bp, Homo sapiens
tatatatata

SEQ ID NO: 136 - DNA, 15 bp, Homo sapiens
gtcgtcgtcgtcgtc

SEQ ID NO: 137 - RNA, 11 nt, Artificial Sequence
  Synthetic
aaaaaauuuuu

SEQ ID NO: 138 - RNA, 11 nt, Artificial Sequence
  Synthetic
uuuuuaaaaaa

SEQ ID NO: 139 - RNA, 17 nt, Artificial Sequence
  Synthetic
aaaaaauuuuuaaaaaa

SEQ ID NO: 140 - RNA, 10 nt, Artificial Sequence
  Synthetic
aaaaauuuuu

SEQ ID NO: 141 - RNA, 11 nt, Artificial Sequence
  Synthetic
aaaaaauuuuu

SEQ ID NO: 142 - RNA, 12 nt, Artificial Sequence
  Synthetic
aaaaaaauuuuu

SEQ ID NO: 143 - RNA, 11 nt, Artificial Sequence
  Synthetic
uuuuuaaaaaa

SEQ ID NO: 144 - RNA, 17 nt, Artificial Sequence
  Synthetic
aaaaaauuuuuaaaaaa

SEQ ID NO: 145 - DNA, 66 bp, Artificial Sequence
  Synthetic
gatttagactaccccaaaaacgaaggggactaaaacctaccaagtaatccatatttctagaggatc

SEQ ID NO: 146 - DNA, 30 bp, Artificial Sequence
  Synthetic
ctaccaagtaatccatatttctagaggatc

SEQ ID NO: 147 - DNA, 36 bp, Artificial Sequence
  Synthetic
gatttagactaccccaaaaacgaaggggactaaaac

SEQ ID NO: 148 - DNA, 66 bp, BERGEYELLA ZOOHELCUM
ctaccaagtaatccatatttctagaggatcgttggaactgctctcattttggagggtaatcacaac

SEQ ID NO: 149 - DNA, 30 bp, ARTIFICIAL SEQUENCE; identical to SEQ ID NO: 146
  Synthetic

SEQ ID NO: 150 - DNA, 36 bp, BERGEYELLA ZOOHELCUM
gttggaactgctctcattttggagggtaatcacaac

SEQ ID NO: 151 - DNA, 66 bp, PREVOTELLA INTERMEDIA
ctaccaagtaatccatatttctagaggatcgttgcatctgcctgctgtttgcaaggtaaaaacaac

SEQ ID NO: 152 - DNA, 30 bp, ARTIFICIAL SEQUENCE; identical to SEQ ID NO: 146
  Synthetic

SEQ ID NO: 153 - DNA, 36 bp, PREVOTELLA INTERMEDIA
gttgcatctgcctgctgtttgcaaggtaaaaacaac

SEQ ID NO: 154 - DNA, 66 bp, PREVOTELLA BUCCAE
ctaccaagtaatccatatttctagaggatcgttgcatctgccttctttttgaaaggtaaaaacaac

SEQ ID NO: 155 - DNA, 30 bp, ARTIFICIAL SEQUENCE; identical to SEQ ID NO: 146
  Synthetic

SEQ ID NO: 156 - DNA, 36 bp, PREVOTELLA BUCCAE
gttgcatctgccttctttttgaaaggtaaaaacaac

SEQ ID NO: 157 - DNA, 66 bp, ALISTIPES SP. ZOR0009
ctaccaagtaatccatatttctagaggatcgctgttatatccttacctttgtaagggaagtacagc

SEQ ID NO: 158 - DNA, 30 bp, ARTIFICIAL SEQUENCE; identical to SEQ ID NO: 146
  Synthetic

SEQ ID NO: 159 - DNA, 36 bp, ALISTIPES SP. ZOR0009
gctgttatatccttacctttgtaagggaagtacagc

SEQ ID NO: 160 - DNA, 66 bp, PREVOTELLA SP. MA2016
ctaccaagtaatccatatttctagaggatcgttgtagaagcttatcgtttggataggtatgacaac

SEQ ID NO: 161 - DNA, 30 bp, ARTIFICIAL SEQUENCE; identical to SEQ ID NO: 146
  Synthetic

SEQ ID NO: 162 - DNA, 36 bp, PREVOTELLA SP. MA2016
gttgtagaagcttatcgtttggataggtatgacaac

SEQ ID NO: 163 - DNA, 66 bp, RIEMERELLA ANATIPESTIFER
ctaccaagtaatccatatttctagaggatcgttgggactgctctcactttgaagggtattcacaac

SEQ ID NO: 164 - DNA, 30 bp, ARTIFICIAL SEQUENCE; identical to SEQ ID NO: 146
  Synthetic

SEQ ID NO: 165 - DNA, 36 bp, RIEMERELLA ANATIPESTIFER
gttgggactgctctcactttgaagggtattcacaac

SEQ ID NO: 166 - DNA, 66 bp, PREVOTELLA AURANTIACA
ctaccaagtaatccatatttctagaggatcgttgtatctgccttctgtttgaaaggtaaaaacaac

SEQ ID NO: 167 - DNA, 30 bp, ARTIFICIAL SEQUENCE; identical to SEQ ID NO: 146
  Synthetic

SEQ ID NO: 168 - DNA, 36 bp, PREVOTELLA AURANTIACA
gttgtatctgccttctgtttgaaaggtaaaaacaac

SEQ ID NO: 169 - DNA, 66 bp, PREVOTELLA SACCHAROLYTICA
ctaccaagtaatccatatttctagaggatcgttgtgtctacctcctttttgagaggtaaaaacagc

SEQ ID NO: 170 - DNA, 30 bp, ARTIFICIAL SEQUENCE; identical to SEQ ID NO: 146
  Synthetic

SEQ ID NO: 171 - DNA, 36 bp, PREVOTELLA SACCHAROLYTICA
gttgtgtctacctcctttttgagaggtaaaaacagc

SEQ ID NO: 172 - DNA, 66 bp, PREVOTELLA INTERMEDIA; identical to SEQ ID NO: 151

SEQ ID NO: 173 - DNA, 30 bp, ARTIFICIAL SEQUENCE; identical to SEQ ID NO: 146
  Synthetic

SEQ ID NO: 174 - DNA, 36 bp, PREVOTELLA INTERMEDIA; identical to SEQ ID NO: 153

SEQ ID NO: 175 - DNA, 66 bp, CAPNOCYTOPHAGA CANIMORSUS; identical to SEQ ID NO: 148

SEQ ID NO: 176 - DNA, 30 bp, ARTIFICIAL SEQUENCE; identical to SEQ ID NO: 146
  Synthetic

SEQ ID NO: 177 - DNA, 36 bp, CAPNOCYTOPHAGA CANIMORSUS; identical to SEQ ID NO: 150

SEQ ID NO: 178 - DNA, 66 bp, PORPHYROMONAS GULAE
ctaccaagtaatccatatttctagaggatcgttggatctaccctctatttgaagggtacacacaac

SEQ ID NO: 179 - DNA, 30 bp, ARTIFICIAL SEQUENCE; identical to SEQ ID NO: 146
  Synthetic

SEQ ID NO: 180 - DNA, 36 bp, PORPHYROMONAS GULAE
gttggatctaccctctatttgaagggtacacacaac

SEQ ID NO: 181 - DNA, 66 bp, Prevotella sp P5-125
ctaccaagtaatccatatttctagaggatcgttgtggaaggtccagttttgaggggctattacaac

SEQ ID NO: 182 - DNA, 30 bp, ARTIFICIAL SEQUENCE; identical to SEQ ID NO: 146
  Synthetic

SEQ ID NO: 183 - DNA, 36 bp, Prevotella sp P5-125
gttgtggaaggtccagttttgaggggctattacaac

SEQ ID NO: 184 - DNA, 66 bp, PORPHYROMONAS GINGIVALIS
ctaccaagtaatccatatttctagaggatcgttggatctaccctctattcgaagggtacacacaac

SEQ ID NO: 185 - DNA, 30 bp, ARTIFICIAL SEQUENCE; identical to SEQ ID NO: 146
  Synthetic

SEQ ID NO: 186 - DNA, 36 bp, PORPHYROMONAS GINGIVALIS
gttggatctaccctctattcgaagggtacacacaac

SEQ ID NO: 187 - DNA, 66 bp, PREVOTELLA INTERMEDIA; identical to SEQ ID NO: 151

SEQ ID NO: 188 - DNA, 30 bp, ARTIFICIAL SEQUENCE; identical to SEQ ID NO: 146
  Synthetic

SEQ ID NO: 189 - DNA, 36 bp, PREVOTELLA INTERMEDIA; identical to SEQ ID NO: 153

SEQ ID NO: 190 - DNA, 64 bp, DENGUE VIRUS
gatttagactaccccaaaaacgaaggggactaaaactgcttctgtccagtgagcatggtcttcg

SEQ ID NO: 191 - DNA, 28 bp, ARTIFICIAL SEQUENCE
  Synthetic
tgcttctgtccagtgagcatggtcttcg

SEQ ID NO: 192 - DNA, 36 bp, DENGUE VIRUS; identical to SEQ ID NO: 147

SEQ ID NO: 193 - DNA, 66 bp, DENGUE VIRUS
tttgcttctgtccagtgagcatggtcttcggttgtagaagcttatcgtttggataggtatgacaac

SEQ ID NO: 194 - DNA, 30 bp, ARTIFICIAL SEQUENCE
  Synthetic
tttgcttctgtccagtgagcatggtcttcg

SEQ ID NO: 195 - DNA, 36 bp, DENGUE VIRUS; identical to SEQ ID NO: 162

SEQ ID NO: 196 - DNA, 40 bp, ARTIFICIAL SEQUENCE
  Synthetic
taatttctactcttgtagatctgtgtttatccgctcacaa

SEQ ID NO: 197 - DNA, 20 bp, ARTIFICIAL SEQUENCE
  Synthetic
ctgtgtttatccgctcacaa

SEQ ID NO: 198 - DNA, 20 bp, ARTIFICIAL SEQUENCE
  Synthetic
taatttctactcttgtagat

SEQ ID NO: 199 - DNA, 66 bp, Homo sapiens
atgctttgtttcaggtgtatcaaccaataagttgtagaagcttatcgtttggataggtatgacaac

SEQ ID NO: 200 - DNA, 30 bp, ARTIFICIAL SEQUENCE
  Synthetic
atgctttgtttcaggtgtatcaaccaataa

SEQ ID NO: 201 - DNA, 36 bp, Homo sapiens; identical to SEQ ID NO: 162

SEQ ID NO: 202 - DNA, 64 bp, Homo sapiens
gatttagactaccccaaaaacgaaggggactaaaacagcacgctcacccgcgggttgccttcgg

SEQ ID NO: 203 - DNA, 28 bp, ARTIFICIAL SEQUENCE
  Synthetic
agcacgctcacccgcgggttgccttcgg

SEQ ID NO: 204 - DNA, 36 bp, Homo sapiens; identical to SEQ ID NO: 147

SEQ ID NO: 205 - DNA, 64 bp, Zika Virus
gatttagactaccccaaaaacgaaggggactaaaacactccctagaaccacgacagtttgcctt

SEQ ID NO: 206 - DNA, 28 bp, Artificial Sequence
  Synthetic
actccctagaaccacgacagtttgcctt

SEQ ID NO: 207 - DNA, 36 bp, Zika Virus; identical to SEQ ID NO: 147

SEQ ID NO: 208 - DNA, 64 bp, Homo sapiens
gatttagactaccccaaaaacgaaggggactaaaacccaggccaaaatctgtgatcttgacatg

SEQ ID NO: 209 - DNA, 28 bp, ARTIFICIAL SEQUENCE
  Synthetic
ccaggccaaaatctgtgatcttgacatg

SEQ ID NO: 210 - DNA, 36 bp, Homo sapiens; identical to SEQ ID NO: 147

SEQ ID NO: 211 - DNA, 64 bp, Homo sapiens
gatttagactaccccaaaaacgaaggggactaaaaccccggccaaaatctgtgatcttgacatg

SEQ ID NO: 212 - DNA, 28 bp, ARTIFICIAL SEQUENCE
  Synthetic
cccggccaaaatctgtgatcttgacatg

SEQ ID NO: 213 - DNA, 35 bp, Homo sapiens
gatttagactaccccaaaaacgaaggggactaaaa

SEQ ID NO: 214 - DNA, 64 bp, Homo sapiens
gatttagactaccccaaaaacgaaggggactaaaacgttggctttcggagatgtcttgatagcg

SEQ ID NO: 215 - DNA, 28 bp, ARTIFICIAL SEQUENCE
  Synthetic
gttggctttcggagatgtcttgatagcg

SEQ ID NO: 216 - DNA, 36 bp, Homo sapiens; identical to SEQ ID NO: 147

SEQ ID NO: 217 - DNA, 64 bp, Homo sapiens
gatttagactaccccaaaaacgaaggggactaaaacgatgttgcttctcttaattccttgatag

SEQ ID NO: 218 - DNA, 28 bp, ARTIFICIAL SEQUENCE
  Synthetic
gatgttgcttctcttaattccttgatag

SEQ ID NO: 219 - DNA, 36 bp, Homo sapiens; identical to SEQ ID NO: 147

SEQ ID NO: 220 - DNA, 64 bp, Homo sapiens
gatttagactaccccaaaaacgaaggggactaaaaccctatcaggtttcacagtaagcgcgtat

SEQ ID NO: 221 - DNA, 28 bp, ARTIFICIAL SEQUENCE
  Synthetic
cctatcaggtttcacagtaagcgcgtat

SEQ ID NO: 222 - DNA, 36 bp, Homo sapiens; identical to SEQ ID NO: 147

SEQ ID NO: 223 - DNA, 66 bp, Homo sapiens
cctggttcatgagcttcctgccactgccaagttgtagaagcttatcgtttggataggtatgacaac

SEQ ID NO: 224 - DNA, 30 bp, ARTIFICIAL SEQUENCE
  Synthetic
cctggttcatgagcttcctgccactgccaa

SEQ ID NO: 225 - DNA, 36 bp, Homo sapiens; identical to SEQ ID NO: 162

SEQ ID NO: 226 - DNA, 63 bp, Dengue Virus
gttgatgagaagagcccaagatagagggcaataactgcttctgtccagtgagcatggtcttcg

SEQ ID NO: 227 - DNA, 28 bp, ARTIFICIAL SEQUENCE
  Synthetic
tgcttctgtccagtgagcatggtcttcg

SEQ ID NO: 228 - DNA, 35 bp, Dengue Virus
gttgatgagaagagcccaagatagagggcaataac

SEQ ID NO: 229 - DNA, 66 bp, Zika Virus
tgactccctagaaccacgacagtttgccttgttgtagaagcttatcgtttggataggtatgacaac

SEQ ID NO: 230 - DNA, 30 bp, ARTIFICIAL SEQUENCE
  Synthetic
tgactccctagaaccacgacagtttgcctt

SEQ ID NO: 231 - DNA, 36 bp, Zika Virus; identical to SEQ ID NO: 162

SEQ ID NO: 232 - DNA, 63 bp, Zika Virus
gttgatgagaagagcccaagatagagggcaataacactccctagaaccacgacagtttgcctt

SEQ ID NO: 233 - DNA, 28 bp, ARTIFICIAL SEQUENCE
  Synthetic
actccctagaaccacgacagtttgcctt

SEQ ID NO: 234 - DNA, 35 bp, Zika Virus; identical to SEQ ID NO: 228

SEQ ID NO: 235 - DNA, 59 bp, Dengue Virus
gaccaccccaaaaatgaaggggactaaaacatgcttctgtccagtgagcatggtcttcg

SEQ ID NO: 236 - DNA, 28 bp, ARTIFICIAL SEQUENCE
  Synthetic
tgcttctgtccagtgagcatggtcttcg

SEQ ID NO: 237 - DNA, 31 bp, Dengue Virus
gaccaccccaaaaatgaaggggactaaaaca

SEQ ID NO: 238 - DNA, 59 bp, Zika Virus
gaccaccccaaaaatgaaggggactaaaacaactccctagaaccacgacagtttgcctt

SEQ ID NO: 239 - DNA, 28 bp, ARTIFICIAL SEQUENCE
  Synthetic
actccctagaaccacgacagtttgcctt

SEQ ID NO: 240 - DNA, 31 bp, Zika Virus; identical to SEQ ID NO: 237

SEQ ID NO: 241 - DNA, 57 bp, Dengue Virus
gaccaccccaaaaatgaaggggactaaaacatgcttctgtccagtgagcatggtctt

SEQ ID NO: 242 - DNA, 26 bp, ARTIFICIAL SEQUENCE
  Synthetic
tgcttctgtccagtgagcatggtctt

SEQ ID NO: 243 - DNA, 31 bp, Dengue Virus; identical to SEQ ID NO: 237

SEQ ID NO: 244 - DNA, 55 bp, Dengue Virus
gaccaccccaaaaatgaaggggactaaaacatgcttctgtccagtgagcatggtc

SEQ ID NO: 245 - DNA, 24 bp, ARTIFICIAL SEQUENCE
  Synthetic
tgcttctgtccagtgagcatggtc

SEQ ID NO: 246 - DNA, 31 bp, Dengue Virus; identical to SEQ ID NO: 237

SEQ ID NO: 247 - DNA, 53 bp, Dengue Virus
gaccaccccaaaaatgaaggggactaaaacatgcttctgtccagtgagcatgg

SEQ ID NO: 248 - DNA, 22 bp, ARTIFICIAL SEQUENCE
  Synthetic
tgcttctgtccagtgagcatgg

SEQ ID NO: 249 - DNA, 31 bp, Dengue Virus; identical to SEQ ID NO: 237

SEQ ID NO: 250 - DNA, 51 bp, Dengue Virus
gaccaccccaaaaatgaaggggactaaaacatgcttctgtccagtgagcat

SEQ ID NO: 251 - DNA, 20 bp, ARTIFICIAL SEQUENCE
  Synthetic
tgcttctgtccagtgagcat

SEQ ID NO: 252 - DNA, 31 bp, Dengue Virus; identical to SEQ ID NO: 237

SEQ ID NO: 253 - DNA, 49 bp, Dengue Virus
gaccaccccaaaaatgaaggggactaaaacatgcttctgtccagtgagc

SEQ ID NO: 254 - DNA, 18 bp, ARTIFICIAL SEQUENCE
  Synthetic
tgcttctgtccagtgagc

SEQ ID NO: 255 - DNA, 31 bp, Dengue Virus; identical to SEQ ID NO: 237

SEQ ID NO: 256 - DNA, 70 bp, Capnocytophaga canimorsus
tgttctaccaagtaatccatatttctagaggatcgttggaactgctctcattttggagggtaatcacaac

SEQ ID NO: 257 - DNA, 34 bp, ARTIFICIAL SEQUENCE
  Synthetic
tgttctaccaagtaatccatatttctagaggatc

SEQ ID NO: 258 - DNA, 36 bp, Capnocytophaga canimorsus; identical to SEQ ID NO: 150

SEQ ID NO: 259 - DNA, 69 bp, Capnocytophaga canimorsus
gttctaccaagtaatccatatttctagaggatcgttggaactgctctcattttggagggtaatcacaac

SEQ ID NO: 260 - DNA, 33 bp, ARTIFICIAL SEQUENCE
  Synthetic
gttctaccaagtaatccatatttctagaggatc

SEQ ID NO: 261 - DNA, 36 bp, Capnocytophaga canimorsus; identical to SEQ ID NO: 150

SEQ ID NO: 262 - DNA, 68 bp, Capnocytophaga canimorsus
ttctaccaagtaatccatatttctagaggatcgttggaactgctctcattttggagggtaatcacaac

SEQ ID NO: 263 - DNA, 32 bp, ARTIFICIAL SEQUENCE
  Synthetic
ttctaccaagtaatccatatttctagaggatc

SEQ ID NO: 264 - DNA, 36 bp, Capnocytophaga canimorsus; identical to SEQ ID NO: 150

SEQ ID NO: 265 - DNA, 67 bp, Capnocytophaga canimorsus
tctaccaagtaatccatatttctagaggatcgttggaactgctctcattttggagggtaatcacaac

SEQ ID NO: 266 - DNA, 31 bp, ARTIFICIAL SEQUENCE
  Synthetic
tctaccaagtaatccatatttctagaggatc

SEQ ID NO: 267 - DNA, 36 bp, Capnocytophaga canimorsus; identical to SEQ ID NO: 150

SEQ ID NO: 268 - DNA, 66 bp, Capnocytophaga canimorsus; identical to SEQ ID NO: 148

SEQ ID NO: 269 - DNA, 30 bp, ARTIFICIAL SEQUENCE; identical to SEQ ID NO: 146
  Synthetic

SEQ ID NO: 270 - DNA, 36 bp, Capnocytophaga canimorsus; identical to SEQ ID NO: 150

SEQ ID NO: 271 - DNA, 65 bp, Capnocytophaga canimorsus
taccaagtaatccatatttctagaggatcgttggaactgctctcattttggagggtaatcacaac

SEQ ID NO: 272 - DNA, 29 bp, ARTIFICIAL SEQUENCE
  Synthetic
taccaagtaatccatatttctagaggatc

SEQ ID NO: 273 - DNA, 36 bp, Capnocytophaga canimorsus; identical to SEQ ID NO: 150

SEQ ID NO: 274 - DNA, 64 bp, Capnocytophaga canimorsus
accaagtaatccatatttctagaggatcgttggaactgctctcattttggagggtaatcacaac

SEQ ID NO: 275 - DNA, 28 bp, ARTIFICIAL SEQUENCE
  Synthetic
accaagtaatccatatttctagaggatc

SEQ ID NO: 276 - DNA, 36 bp, Capnocytophaga canimorsus; identical to SEQ ID NO: 150

SEQ ID NO: 277 - DNA, 63 bp, Capnocytophaga canimorsus
ccaagtaatccatatttctagaggatcgttggaactgctctcattttggagggtaatcacaac

SEQ ID NO: 278 - DNA, 27 bp, ARTIFICIAL SEQUENCE
  Synthetic
ccaagtaatccatatttctagaggatc

SEQ ID NO: 279 - DNA, 36 bp, Capnocytophaga canimorsus; identical to SEQ ID NO: 150

SEQ ID NO: 280 - DNA, 62 bp, Capnocytophaga canimorsus
caagtaatccatatttctagaggatcgttggaactgctctcattttggagggtaatcacaac

SEQ ID NO: 281 - DNA, 26 bp, ARTIFICIAL SEQUENCE
  Synthetic
caagtaatccatatttctagaggatc

SEQ ID NO: 282 - DNA, 36 bp, Capnocytophaga canimorsus; identical to SEQ ID NO: 150

SEQ ID NO: 283 - DNA, 61 bp, Capnocytophaga canimorsus
aagtaatccatatttctagaggatcgttggaactgctctcattttggagggtaatcacaac

SEQ ID NO: 284 - DNA, 25 bp, ARTIFICIAL SEQUENCE
  Synthetic
aagtaatccatatttctagaggatc

SEQ ID NO: 285 - DNA, 36 bp, Capnocytophaga canimorsus; identical to SEQ ID NO: 150

SEQ ID NO: 286 - DNA, 60 bp, Capnocytophaga canimorsus
agtaatccatatttctagaggatcgttggaactgctctcattttggagggtaatcacaac

SEQ ID NO: 287 - DNA, 24 bp, ARTIFICIAL SEQUENCE
  Synthetic
agtaatccatatttctagaggatc

SEQ ID NO: 288 - DNA, 36 bp, Capnocytophaga canimorsus; identical to SEQ ID NO: 150

SEQ ID NO: 289 - DNA, 59 bp, Capnocytophaga canimorsus
gtaatccatatttctagaggatcgttggaactgctctcattttggagggtaatcacaac

SEQ ID NO: 290 - DNA, 23 bp, ARTIFICIAL SEQUENCE
  Synthetic
gtaatccatatttctagaggatc

SEQ ID NO: 291 - DNA, 36 bp, Capnocytophaga canimorsus; identical to SEQ ID NO: 150

SEQ ID NO: 292 - DNA, 58 bp, Capnocytophaga canimorsus
taatccatatttctagaggatcgttggaactgctctcattttggagggtaatcacaac

SEQ ID NO: 293 - DNA, 22 bp, ARTIFICIAL SEQUENCE
  Synthetic
taatccatatttctagaggatc

SEQ ID NO: 294 - DNA, 36 bp, Capnocytophaga canimorsus; identical to SEQ ID NO: 150

SEQ ID NO: 295 - DNA, 57 bp, Capnocytophaga canimorsus
aatccatatttctagaggatcgttggaactgctctcattttggagggtaatcacaac

SEQ ID NO: 296 - DNA, 21 bp, ARTIFICIAL SEQUENCE
  Synthetic
aatccatatttctagaggatc

SEQ ID NO: 297 - DNA, 36 bp, Capnocytophaga canimorsus; identical to SEQ ID NO: 150

SEQ ID NO: 298 - DNA, 56 bp, Capnocytophaga canimorsus
atccatatttctagaggatcgttggaactgctctcattttggagggtaatcacaac

SEQ ID NO: 299 - DNA, 20 bp, ARTIFICIAL SEQUENCE
  Synthetic
atccatatttctagaggatc

SEQ ID NO: 300 - DNA, 36 bp, Capnocytophaga canimorsus; identical to SEQ ID NO: 150

SEQ ID NO: 301 - DNA, 55 bp, Capnocytophaga canimorsus
tccatatttctagaggatcgttggaactgctctcattttggagggtaatcacaac

SEQ ID NO: 302 - DNA, 19 bp, ARTIFICIAL SEQUENCE
  Synthetic
tccatatttctagaggatc

SEQ ID NO: 303 - DNA, 36 bp, Capnocytophaga canimorsus; identical to SEQ ID NO: 150

SEQ ID NO: 304 - DNA, 54 bp, Capnocytophaga canimorsus
ccatatttctagaggatcgttggaactgctctcattttggagggtaatcacaac

SEQ ID NO: 305 - DNA, 18 bp, ARTIFICIAL SEQUENCE
  Synthetic
ccatatttctagaggatc

SEQ ID NO: 306 - DNA, 36 bp, Capnocytophaga canimorsus; identical to SEQ ID NO: 150

SEQ ID NO: 307 - DNA, 53 bp, Capnocytophaga canimorsus
catatttctagaggatcgttggaactgctctcattttggagggtaatcacaac

SEQ ID NO: 308 - DNA, 17 bp, ARTIFICIAL SEQUENCE
  Synthetic
catatttctagaggatc

SEQ ID NO: 309 - DNA, 36 bp, Capnocytophaga canimorsus; identical to SEQ ID NO: 150

SEQ ID NO: 310 - DNA, 52 bp, Capnocytophaga canimorsus
atatttctagaggatcgttggaactgctctcattttggagggtaatcacaac

SEQ ID NO: 311 - DNA, 16 bp, ARTIFICIAL SEQUENCE
  Synthetic
atatttctagaggatc

SEQ ID NO: 312 - DNA, 36 bp, Capnocytophaga canimorsus; identical to SEQ ID NO: 150

SEQ ID NO: 313 - DNA, 51 bp, Capnocytophaga canimorsus
tatttctagaggatcgttggaactgctctcattttggagggtaatcacaac

SEQ ID NO: 314 - DNA, 15 bp, ARTIFICIAL SEQUENCE
  Synthetic
tatttctagaggatc

SEQ ID NO: 315 - DNA, 36 bp, Capnocytophaga canimorsus; identical to SEQ ID NO: 150

SEQ ID NO: 316 - DNA, 50 bp, Capnocytophaga canimorsus
atttctagaggatcgttggaactgctctcattttggagggtaatcacaac

SEQ ID NO: 317 - DNA, 14 bp, ARTIFICIAL SEQUENCE
  Synthetic
atttctagaggatc

SEQ ID NO: 318 - DNA, 36 bp, Capnocytophaga canimorsus; identical to SEQ ID NO: 150

SEQ ID NO: 319 - DNA, 49 bp, Capnocytophaga canimorsus
tttctagaggatcgttggaactgctctcattttggagggtaatcacaac

SEQ ID NO: 320 - DNA, 13 bp, ARTIFICIAL SEQUENCE
  Synthetic
tttctagaggatc

SEQ ID NO: 321 - DNA, 36 bp, Capnocytophaga canimorsus; identical to SEQ ID NO: 150

SEQ ID NO: 322 - DNA, 48 bp, Capnocytophaga canimorsus
ttctagaggatcgttggaactgctctcattttggagggtaatcacaac

SEQ ID NO: 323 - DNA, 12 bp, ARTIFICIAL SEQUENCE
  Synthetic
ttctagaggatc

SEQ ID NO: 324 - DNA, 36 bp, Capnocytophaga canimorsus; identical to SEQ ID NO: 150

SEQ ID NO: 325 - DNA, 70 bp, Prevotella sp. MA2016
tgttctaccaagtaatccatatttctagaggatcgttgtagaagcttatcgtttggataggtatgacaac

SEQ ID NO: 326 - DNA, 34 bp, ARTIFICIAL SEQUENCE; identical to SEQ ID NO: 257
  Synthetic

SEQ ID NO: 327 - DNA, 36 bp, Prevotella sp. MA2016; identical to SEQ ID NO: 162

SEQ ID NO: 328 - DNA, 69 bp, Prevotella sp. MA2016
gttctaccaagtaatccatatttctagaggatcgttgtagaagcttatcgtttggataggtatgacaac

SEQ ID NO: 329 - DNA, 33 bp, ARTIFICIAL SEQUENCE; identical to SEQ ID NO: 260
  Synthetic

SEQ ID NO: 330 - DNA, 36 bp, Prevotella sp. MA2016; identical to SEQ ID NO: 162

SEQ ID NO: 331 - DNA, 68 bp, Prevotella sp. MA2016
ttctaccaagtaatccatatttctagaggatcgttgtagaagcttatcgtttggataggtatgacaac

SEQ ID NO: 332 - DNA, 32 bp, ARTIFICIAL SEQUENCE; identical to SEQ ID NO: 263
  Synthetic

SEQ ID NO: 333 - DNA, 36 bp, Prevotella sp. MA2016; identical to SEQ ID NO: 162

SEQ ID NO: 334 - DNA, 67 bp, Prevotella sp. MA2016
tctaccaagtaatccatatttctagaggatcgttgtagaagcttatcgtttggataggtatgacaac

SEQ ID NO: 335 - DNA, 31 bp, ARTIFICIAL SEQUENCE; identical to SEQ ID NO: 266
  Synthetic

SEQ ID NO: 336 - DNA, 36 bp, Prevotella sp. MA2016; identical to SEQ ID NO: 162

SEQ ID NO: 337 - DNA, 66 bp, Prevotella sp. MA2016; identical to SEQ ID NO: 160

SEQ ID NO: 338 - DNA, 30 bp, ARTIFICIAL SEQUENCE; identical to SEQ ID NO: 146
  Synthetic

SEQ ID NO: 339 - DNA, 36 bp, Prevotella sp. MA2016; identical to SEQ ID NO: 162

SEQ ID NO: 340 - DNA, 65 bp, Prevotella sp. MA2016
taccaagtaatccatatttctagaggatcgttgtagaagcttatcgtttggataggtatgacaac

SEQ ID NO: 341 - DNA, 29 bp, ARTIFICIAL SEQUENCE
  Synthetic
taccaagtaatccatatttctagaggatc

SEQ ID NO: 342 - DNA, 36 bp, Prevotella sp. MA2016; identical to SEQ ID NO: 162

SEQ ID NO: 343 - DNA, 64 bp, Prevotella sp. MA2016
accaagtaatccatatttctagaggatcgttgtagaagcttatcgtttggataggtatgacaac

SEQ ID NO: 344 - DNA, 28 bp, ARTIFICIAL SEQUENCE
  Synthetic
accaagtaatccatatttctagaggatc

SEQ ID NO: 345 - DNA, 36 bp, Prevotella sp. MA2016; identical to SEQ ID NO: 162

SEQ ID NO: 346 - DNA, 63 bp, Prevotella sp. MA2016
ccaagtaatccatatttctagaggatcgttgtagaagcttatcgtttggataggtatgacaac

SEQ ID NO: 347 - DNA, 27 bp, ARTIFICIAL SEQUENCE
  Synthetic
ccaagtaatccatatttctagaggatc

SEQ ID NO: 348 - DNA, 36 bp, Prevotella sp. MA2016; identical to SEQ ID NO: 162

SEQ ID NO: 349 - DNA, 62 bp, Prevotella sp. MA2016
caagtaatccatatttctagaggatcgttgtagaagcttatcgtttggataggtatgacaac

SEQ ID NO: 350 - DNA, 26 bp, ARTIFICIAL SEQUENCE
  Synthetic
caagtaatccatatttctagaggatc

SEQ ID NO: 351 - DNA, 36 bp, Prevotella sp. MA2016; identical to SEQ ID NO: 162

SEQ ID NO: 352 - DNA, 61 bp, Prevotella sp. MA2016
aagtaatccatatttctagaggatcgttgtagaagcttatcgtttggataggtatgacaac

SEQ ID NO: 353 - DNA, 25 bp, ARTIFICIAL SEQUENCE
  Synthetic
aagtaatccatatttctagaggatc

SEQ ID NO: 354 - DNA, 36 bp, Prevotella sp. MA2016; identical to SEQ ID NO: 162

SEQ ID NO: 355 - DNA, 60 bp, Prevotella sp. MA2016
agtaatccatatttctagaggatcgttgtagaagcttatcgtttggataggtatgacaac

SEQ ID NO: 356 - DNA, 24 bp, ARTIFICIAL SEQUENCE
  Synthetic
agtaatccatatttctagaggatc

SEQ ID NO: 357 - DNA, 36 bp, Prevotella sp. MA2016; identical to SEQ ID NO: 162

SEQ ID NO: 358 - DNA, 59 bp, Prevotella sp. MA2016
gtaatccatatttctagaggatcgttgtagaagcttatcgtttggataggtatgacaac

SEQ ID NO: 359 - DNA, 23 bp, ARTIFICIAL SEQUENCE
  Synthetic
gtaatccatatttctagaggatc

SEQ ID NO: 360 - DNA, 36 bp, Prevotella sp. MA2016; identical to SEQ ID NO: 162

SEQ ID NO: 361 - DNA, 58 bp, PREVOTELLA SP. MA2016
taatccatatttctagaggatcgttgtagaagcttatcgtttggataggtatgacaac

SEQ ID NO: 362 - DNA, 22 bp, ARTIFICIAL SEQUENCE
  Synthetic
taatccatatttctagaggatc

SEQ ID NO: 363 - DNA, 36 bp, PREVOTELLA SP. MA2016; identical to SEQ ID NO: 162

SEQ ID NO: 364 - DNA, 57 bp, PREVOTELLA SP. MA2016
aatccatatttctagaggatcgttgtagaagcttatcgtttggataggtatgacaac

SEQ ID NO: 365 - DNA, 21 bp, ARTIFICIAL SEQUENCE
  Synthetic
aatccatatttctagaggatc

SEQ ID NO: 366 - DNA, 36 bp, PREVOTELLA SP. MA2016; identical to SEQ ID NO: 162

SEQ ID NO: 367 - DNA, 56 bp, PREVOTELLA SP. MA2016
atccatatttctagaggatcgttgtagaagcttatcgtttggataggtatgacaac

SEQ ID NO: 368 - DNA, 20 bp, ARTIFICIAL SEQUENCE
  Synthetic
atccatatttctagaggatc

SEQ ID NO: 369 - DNA, 36 bp, PREVOTELLA SP. MA2016; identical to SEQ ID NO: 162

SEQ ID NO: 370 - DNA, 55 bp, PREVOTELLA SP. MA2016
tccatatttctagaggatcgttgtagaagcttatcgtttggataggtatgacaac

SEQ ID NO: 371 - DNA, 19 bp, ARTIFICIAL SEQUENCE
  Synthetic
tccatatttctagaggatc

SEQ ID NO: 372 - DNA, 36 bp, PREVOTELLA SP. MA2016; identical to SEQ ID NO: 162

SEQ ID NO: 373 - DNA, 54 bp, PREVOTELLA SP. MA2016
ccatatttctagaggatcgttgtagaagcttatcgtttggataggtatgacaac

SEQ ID NO: 374 - DNA, 18 bp, ARTIFICIAL SEQUENCE
  Synthetic
ccatatttctagaggatc

SEQ ID NO: 375 - DNA, 36 bp, PREVOTELLA SP. MA2016; identical to SEQ ID NO: 162

SEQ ID NO: 376 - DNA, 34 bp, PREVOTELLA SP. MA2016
tgtagaagcttatcgtttggataggtatgacaac

SEQ ID NO: 377 - DNA, 17 bp, ARTIFICIAL SEQUENCE
  Synthetic
catatttctagaggatc

SEQ ID NO: 378 - DNA, 36 bp, PREVOTELLA SP. MA2016; identical to SEQ ID NO: 162

SEQ ID NO: 379 - DNA, 52 bp, PREVOTELLA SP. MA2016
atatttctagaggatcgttgtagaagcttatcgtttggataggtatgacaac

SEQ ID NO: 380 - DNA, 16 bp, ARTIFICIAL SEQUENCE
  Synthetic
atatttctagaggatc

SEQ ID NO: 381 - DNA, 36 bp, PREVOTELLA SP. MA2016; identical to SEQ ID NO: 162

SEQ ID NO: 382 - DNA, 51 bp, PREVOTELLA SP. MA2016
tatttctagaggatcgttgtagaagcttatcgtttggataggtatgacaac

SEQ ID NO: 383 - DNA, 15 bp, ARTIFICIAL SEQUENCE
  Synthetic
tatttctagaggatc

SEQ ID NO: 384 - DNA, 36 bp, PREVOTELLA SP. MA2016; identical to SEQ ID NO: 162

SEQ ID NO: 385 - DNA, 50 bp, PREVOTELLA SP. MA2016
atttctagaggatcgttgtagaagcttatcgtttggataggtatgacaac

SEQ ID NO: 386 - DNA, 14 bp, ARTIFICIAL SEQUENCE
  Synthetic
atttctagaggatc

SEQ ID NO: 387 - DNA, 36 bp, PREVOTELLA SP. MA2016; identical to SEQ ID NO: 162

SEQ ID NO: 388 - DNA, 49 bp, PREVOTELLA SP. MA2016
tttctagaggatcgttgtagaagcttatcgtttggataggtatgacaac

SEQ ID NO: 389 - DNA, 13 bp, ARTIFICIAL SEQUENCE
  Synthetic
tttctagaggatc

SEQ ID NO: 390 - DNA, 36 bp, PREVOTELLA SP. MA2016; identical to SEQ ID NO: 162

SEQ ID NO: 391 - DNA, 48 bp, PREVOTELLA SP. MA2016
ttctagaggatcgttgtagaagcttatcgtttggataggtatgacaac

SEQ ID NO: 392 - DNA, 12 bp, ARTIFICIAL SEQUENCE
  Synthetic
ttctagaggatc

SEQ ID NO: 393 - DNA, 36 bp, PREVOTELLA SP. MA2016; identical to SEQ ID NO: 162

SEQ ID NO: 394 - DNA, 64 bp, LEPTOTRICHIA WADEI
gatttagactaccccaaaaacgaaggggactaaaacccgggtaccgagctcgaattcactggcc

SEQ ID NO: 395 - DNA, 28 bp, ARTIFICIAL SEQUENCE
  Synthetic
ccgggtaccgagctcgaattcactggcc

SEQ ID NO: 396 - DNA, 36 bp, LEPTOTRICHIA WADEI; identical to SEQ ID NO: 147

SEQ ID NO: 397 - DNA, 64 bp, LEPTOTRICHIA WADEI
gatttagactaccccaaaaacgaaggggactaaaactttctagaggatccccgggtaccgagct

SEQ ID NO: 398 - DNA, 28 bp, ARTIFICIAL SEQUENCE
  Synthetic
tttctagaggatccccgggtaccgagct

SEQ ID NO: 399 - DNA, 36 bp, LEPTOTRICHIA WADEI; identical to SEQ ID NO: 147

SEQ ID NO: 400 - DNA, 64 bp, LEPTOTRICHIA WADEI
gatttagactaccccaaaaacgaaggggactaaaacccaagtaatccatatttctagaggatcc

SEQ ID NO: 401 - DNA, 28 bp, ARTIFICIAL SEQUENCE
  Synthetic
ccaagtaatccatatttctagaggatcc

SEQ ID NO: 402 - DNA, 36 bp, LEPTOTRICHIA WADEI; identical to SEQ ID NO: 147

SEQ ID NO: 403 - DNA, 64 bp, LEPTOTRICHIA WADEI
gatttagactaccccaaaaacgaaggggactaaaacagattgctgttctaccaagtaatccata

SEQ ID NO: 404 - DNA, 28 bp, ARTIFICIAL SEQUENCE
  Synthetic
agattgctgttctaccaagtaatccata

SEQ ID NO: 405 - DNA, 36 bp, LEPTOTRICHIA WADEI; identical to SEQ ID NO: 147

SEQ ID NO: 406 - DNA, 64 bp, LEPTOTRICHIA WADEI
gatttagactaccccaaaaacgaaggggactaaaaccctgcaggtcgagtagattgctgttcta

SEQ ID NO: 407 - DNA, 28 bp, ARTIFICIAL SEQUENCE
  Synthetic
cctgcaggtcgagtagattgctgttcta

SEQ ID NO: 408 - DNA, 36 bp, LEPTOTRICHIA WADEI; identical to SEQ ID NO: 147

SEQ ID NO: 409 - DNA, 64 bp, LEPTOTRICHIA WADEI
gatttagactaccccaaaaacgaaggggactaaaacgccaagcttgcatgcctgcaggtcgagt

SEQ ID NO: 410 - DNA, 28 bp, ARTIFICIAL SEQUENCE
  Synthetic
gccaagcttgcatgcctgcaggtcgagt

SEQ ID NO: 411 - DNA, 36 bp, LEPTOTRICHIA WADEI; identical to SEQ ID NO: 147

SEQ ID NO: 412 - DNA, 64 bp, LEPTOTRICHIA WADEI
gatttagactaccccaaaaacgaaggggactaaaacatgaccatgattacgccaagcttgcatg

SEQ ID NO: 413 - DNA, 28 bp, ARTIFICIAL SEQUENCE
  Synthetic
atgaccatgattacgccaagcttgcatg

SEQ ID NO: 414 - DNA, 36 bp, LEPTOTRICHIA WADEI; identical to SEQ ID NO: 147

SEQ ID NO: 415 - DNA, 64 bp, LEPTOTRICHIA WADEI
gatttagactaccccaaaaacgaaggggactaaaaccacaggaaacagctatgaccatgattac

SEQ ID NO: 416 - DNA, 28 bp, ARTIFICIAL SEQUENCE
  Synthetic
cacaggaaacagctatgaccatgattac

SEQ ID NO: 417 - DNA, 36 bp, LEPTOTRICHIA WADEI; identical to SEQ ID NO: 147

SEQ ID NO: 418 - DNA, 64 bp, LEPTOTRICHIA WADEI
gatttagactaccccaaaaacgaaggggactaaaactgtgagcggataaacacaggaaacagct

SEQ ID NO: 419 - DNA, 28 bp, ARTIFICIAL SEQUENCE
  Synthetic
tgtgagcggataaacacaggaaacagct

SEQ ID NO: 420 - DNA, 36 bp, LEPTOTRICHIA WADEI; identical to SEQ ID NO: 147

SEQ ID NO: 421 - DNA, 64 bp, LEPTOTRICHIA WADEI
gatttagactaccccaaaaacgaaggggactaaaacatgttgtgtggaattgtgagcggataaa

SEQ ID NO: 422 - DNA, 28 bp, ARTIFICIAL SEQUENCE
  Synthetic
atgttgtgtggaattgtgagcggataaa

SEQ ID NO: 423 - DNA, 36 bp, LEPTOTRICHIA WADEI; identical to SEQ ID NO: 147

SEQ ID NO: 424 - DNA, 64 bp, LEPTOTRICHIA WADEI
gatttagactaccccaaaaacgaaggggactaaaactgcttccggctcgtatgttgtgtggaat

SEQ ID NO: 425 - DNA, 28 bp, ARTIFICIAL SEQUENCE
  Synthetic
tgcttccggctcgtatgttgtgtggaat

SEQ ID NO: 426 - DNA, 36 bp, LEPTOTRICHIA WADEI; identical to SEQ ID NO: 147

SEQ ID NO: 427 - DNA, 66 bp, Capnocytophaga canimorsus
ccccgggtaccgagctcgaattcactggccgttggaactgctctcattttggagggtaatcacaac

SEQ ID NO: 428 - DNA, 30 bp, ARTIFICIAL SEQUENCE
  Synthetic
ccccgggtaccgagctcgaattcactggcc

SEQ ID NO: 429 - DNA, 36 bp, Capnocytophaga canimorsus; identical to SEQ ID NO: 150

SEQ ID NO: 430 - DNA, 66 bp, Capnocytophaga canimorsus
tatttctagaggatccccgggtaccgagctgttggaactgctctcattttggagggtaatcacaac

SEQ ID NO: 431 - DNA, 30 bp, ARTIFICIAL SEQUENCE
  Synthetic
tatttctagaggatccccgggtaccgagct

SEQ ID NO: 432 - DNA, 36 bp, Capnocytophaga canimorsus; identical to SEQ ID NO: 150

SEQ ID NO: 433 - DNA, 66 bp, Capnocytophaga canimorsus
taccaagtaatccatatttctagaggatccgttggaactgctctcattttggagggtaatcacaac

SEQ ID NO: 434 - DNA, 30 bp, ARTIFICIAL SEQUENCE
  Synthetic
taccaagtaatccatatttctagaggatcc

SEQ ID NO: 435 - DNA, 36 bp, Capnocytophaga canimorsus; identical to SEQ ID NO: 150

SEQ ID NO: 436 - DNA, 66 bp, Capnocytophaga canimorsus
gtagattgctgttctaccaagtaatccatagttggaactgctctcattttggagggtaatcacaac

SEQ ID NO: 437 - DNA, 30 bp, ARTIFICIAL SEQUENCE
  Synthetic
gtagattgctgttctaccaagtaatccata

SEQ ID NO: 438 - DNA, 36 bp, Capnocytophaga canimorsus; identical to SEQ ID NO: 150

SEQ ID NO: 439 - DNA, 66 bp, Capnocytophaga canimorsus
tgcctgcaggtcgagtagattgctgttctagttggaactgctctcattttggagggtaatcacaac

SEQ ID NO: 440 - DNA, 30 bp, ARTIFICIAL SEQUENCE
  Synthetic
tgcctgcaggtcgagtagattgctgttcta

SEQ ID NO: 441 - DNA, 36 bp, Capnocytophaga canimorsus; identical to SEQ ID NO: 150

SEQ ID NO: 442 - DNA, 66 bp, Capnocytophaga canimorsus
acgccaagcttgcatgcctgcaggtcgagtgttggaactgctctcattttggagggtaatcacaac

SEQ ID NO: 443 - DNA, 30 bp, ARTIFICIAL SEQUENCE
  Synthetic
acgccaagcttgcatgcctgcaggtcgagt

SEQ ID NO: 444 - DNA, 36 bp, Capnocytophaga canimorsus; identical to SEQ ID NO: 150

SEQ ID NO: 445 - DNA, 66 bp, Capnocytophaga canimorsus
ctatgaccatgattacgccaagcttgcatggttggaactgctctcattttggagggtaatcacaac

SEQ ID NO: 446 - DNA, 30 bp, ARTIFICIAL SEQUENCE
  Synthetic
ctatgaccatgattacgccaagcttgcatg

SEQ ID NO: 447 - DNA, 36 bp, Capnocytophaga canimorsus; identical to SEQ ID NO: 150

SEQ ID NO: 448 - DNA, 66 bp, Capnocytophaga canimorsus
aacacaggaaacagctatgaccatgattacgttggaactgctctcattttggagggtaatcacaac

SEQ ID NO: 449 - DNA, 30 bp, ARTIFICIAL SEQUENCE
  Synthetic
aacacaggaaacagctatgaccatgattac

SEQ ID NO: 450 - DNA, 36 bp, Capnocytophaga canimorsus; identical to SEQ ID NO: 150

SEQ ID NO: 451 - DNA, 66 bp, Capnocytophaga canimorsus
attgtgagcggataaacacaggaaacagctgttggaactgctctcattttggagggtaatcacaac

SEQ ID NO: 452 - DNA, 30 bp, ARTIFICIAL SEQUENCE
  Synthetic
attgtgagcggataaacacaggaaacagct

SEQ ID NO: 453 - DNA, 36 bp, Capnocytophaga canimorsus; identical to SEQ ID NO: 150

SEQ ID NO: 454 - DNA, 66 bp, Capnocytophaga canimorsus
gtatgttgtgtggaattgtgagcggataaagttggaactgctctcattttggagggtaatcacaac

SEQ ID NO: 455 - DNA, 30 bp, ARTIFICIAL SEQUENCE
  Synthetic
gtatgttgtgtggaattgtgagcggataaa

SEQ ID NO: 456 - DNA, 36 bp, Capnocytophaga canimorsus; identical to SEQ ID NO: 150

SEQ ID NO: 457 - DNA, 66 bp, Capnocytophaga canimorsus
tatgcttccggctcgtatgttgtgtggaatgttggaactgctctcattttggagggtaatcacaac

SEQ ID NO: 458 - DNA, 30 bp, ARTIFICIAL SEQUENCE
  Synthetic
tatgcttccggctcgtatgttgtgtggaat

SEQ ID NO: 459 - DNA, 36 bp, Capnocytophaga canimorsus; identical to SEQ ID NO: 150

SEQ ID NO: 460 - DNA, 66 bp, PREVOTELLA SP. MA2016
ccccgggtaccgagctcgaattcactggccgttgtagaagcttatcgtttggataggtatgacaac

SEQ ID NO: 461 - DNA, 30 bp, ARTIFICIAL SEQUENCE; identical to SEQ ID NO: 428
  Synthetic

SEQ ID NO: 462 - DNA, 36 bp, PREVOTELLA SP. MA2016; identical to SEQ ID NO: 162

SEQ ID NO: 463 - DNA, 66 bp, PREVOTELLA SP. MA2016
tatttctagaggatccccgggtaccgagctgttgtagaagcttatcgtttggataggtatgacaac

SEQ ID NO: 464 - DNA, 30 bp, ARTIFICIAL SEQUENCE; identical to SEQ ID NO: 431
  Synthetic

SEQ ID NO: 465 - DNA, 36 bp, PREVOTELLA SP. MA2016; identical to SEQ ID NO: 162

SEQ ID NO: 466 - DNA, 66 bp, PREVOTELLA SP. MA2016
taccaagtaatccatatttctagaggatccgttgtagaagcttatcgtttggataggtatgacaac

SEQ ID NO: 467 - DNA, 30 bp, ARTIFICIAL SEQUENCE; identical to SEQ ID NO: 434
  Synthetic

SEQ ID NO: 468 - DNA, 36 bp, PREVOTELLA SP. MA2016; identical to SEQ ID NO: 162

SEQ ID NO: 469 - DNA, 66 bp, PREVOTELLA SP. MA2016
gtagattgctgttctaccaagtaatccatagttgtagaagcttatcgtttggataggtatgacaac

SEQ ID NO: 470 - DNA, 30 bp, ARTIFICIAL SEQUENCE; identical to SEQ ID NO: 437
  Synthetic

SEQ ID NO: 471 - DNA, 36 bp, PREVOTELLA SP. MA2016; identical to SEQ ID NO: 162

SEQ ID NO: 472 - DNA, 66 bp, PREVOTELLA SP. MA2016
tgcctgcaggtcgagtagattgctgttctagttgtagaagcttatcgtttggataggtatgacaac

SEQ ID NO: 473 - DNA, 30 bp, ARTIFICIAL SEQUENCE; identical to SEQ ID NO: 440
  Synthetic

SEQ ID NO: 474 - DNA, 36 bp, PREVOTELLA SP. MA2016; identical to SEQ ID NO: 162

SEQ ID NO: 475 - DNA, 47 bp, PREVOTELLA SP. MA2016
gcaggtcgagtgttgtagaagcttatcgtttggataggtatgacaac

SEQ ID NO: 476 - DNA, 30 bp, ARTIFICIAL SEQUENCE; identical to SEQ ID NO: 443
  Synthetic

SEQ ID NO: 477 - DNA, 36 bp, PREVOTELLA SP. MA2016; identical to SEQ ID NO: 162

SEQ ID NO: 478 - DNA, 66 bp, PREVOTELLA SP. MA2016
ctatgaccatgattacgccaagcttgcatggttgtagaagcttatcgtttggataggtatgacaac

SEQ ID NO: 479 - DNA, 30 bp, ARTIFICIAL SEQUENCE; identical to SEQ ID NO: 446
  Synthetic

SEQ ID NO: 480 - DNA, 36 bp, PREVOTELLA SP. MA2016; identical to SEQ ID NO: 162

SEQ ID NO: 481 - DNA, 66 bp, PREVOTELLA SP. MA2016
aacacaggaaacagctatgaccatgattacgttgtagaagcttatcgtttggataggtatgacaac

SEQ ID NO: 482 - DNA, 30 bp, ARTIFICIAL SEQUENCE; identical to SEQ ID NO: 449
  Synthetic

SEQ ID NO: 483 - DNA, 36 bp, PREVOTELLA SP. MA2016; identical to SEQ ID NO: 162

SEQ ID NO: 484 - DNA, 66 bp, PREVOTELLA SP. MA2016
attgtgagcggataaacacaggaaacagctgttgtagaagcttatcgtttggataggtatgacaac

SEQ ID NO: 485 - DNA, 30 bp, ARTIFICIAL SEQUENCE; identical to SEQ ID NO: 452
  Synthetic

SEQ ID NO: 486 - DNA, 36 bp, PREVOTELLA SP. MA2016; identical to SEQ ID NO: 162

SEQ ID NO: 487 - DNA, 66 bp, PREVOTELLA SP. MA2016
gtatgttgtgtggaattgtgagcggataaagttgtagaagcttatcgtttggataggtatgacaac

SEQ ID NO: 488 - DNA, 30 bp, ARTIFICIAL SEQUENCE; identical to SEQ ID NO: 455
  Synthetic

SEQ ID NO: 489 - DNA, 36 bp, PREVOTELLA SP. MA2016; identical to SEQ ID NO: 162

SEQ ID NO: 490 - DNA, 66 bp, PREVOTELLA SP. MA2016
tatgcttccggctcgtatgttgtgtggaatgttgtagaagcttatcgtttggataggtatgacaac

SEQ ID NO: 491 - DNA, 30 bp, ARTIFICIAL SEQUENCE; identical to SEQ ID NO: 458
  Synthetic

SEQ ID NO: 492 - DNA, 36 bp, PREVOTELLA SP. MA2016; identical to SEQ ID NO: 162

SEQ ID NO: 493 - DNA, 66 bp, ZIKA Virus
cttgaactctaccagtgcttctttgttgttgttggaactgctctcattttggagggtaatcacaac

SEQ ID NO: 494 - DNA, 30 bp, ARTIFICIAL SEQUENCE
  Synthetic
cttgaactctaccagtgcttctttgttgtt

SEQ ID NO: 495 - DNA, 36 bp, ZIKA Virus; identical to SEQ ID NO: 150

SEQ ID NO: 496 - DNA, 66 bp, Dengue Virus
tttgcttctgtccagtgagcatggtcttcggttggaactgctctcattttggagggtaatcacaac

SEQ ID NO: 497 - DNA, 30 bp, ARTIFICIAL SEQUENCE; identical to SEQ ID NO: 194
  Synthetic

SEQ ID NO: 498 - DNA, 36 bp, Dengue Virus; identical to SEQ ID NO: 150

SEQ ID NO: 499 - DNA, 65 bp, Homo sapiens
ccgcttcaccggctacccctgctccaagagttgtagaagcttatcgtttggataggtatgacaac

SEQ ID NO: 500 - DNA, 29 bp, ARTIFICIAL SEQUENCE
  Synthetic
ccgcttcaccggctacccctgctccaaga

SEQ ID NO: 501 - DNA, 36 bp, Homo sapiens; identical to SEQ ID NO: 162

SEQ ID NO: 502 - DNA, 64 bp, Homo sapiens
gatttagactaccccaaaaacgaaggggactaaaacctgcaccttctaccaccacctccgccag

SEQ ID NO: 503 - DNA, 28 bp, ARTIFICIAL SEQUENCE
  Synthetic
ctgcaccttctaccaccacctccgccag

SEQ ID NO: 504 - DNA, 36 bp, Homo sapiens; identical to SEQ ID NO: 147

SEQ ID NO: 505 - DNA, 64 bp, ARTIFICIAL SEQUENCE
  Synthetic
gatttagactaccccaaaaacgaaggggactaaaactagattgctgttctaccaagtaatccat

SEQ ID NO: 506 - DNA, 28 bp, ARTIFICIAL SEQUENCE
  Synthetic
tagattgctgttctaccaagtaatccat

SEQ ID NO: 507 - DNA, 36 bp, ARTIFICIAL SEQUENCE; identical to SEQ ID NO: 147
  Synthetic

SEQ ID NO: 508 - DNA, 64 bp, Homo sapiens
gatttagactaccccaaaaacgaaggggactaaaacgcaagatgagctgcacggtggaggtgag

SEQ ID NO: 509 - DNA, 28 bp, ARTIFICIAL SEQUENCE
  Synthetic
gcaagatgagctgcacggtggaggtgag

SEQ ID NO: 510 - DNA, 36 bp, Homo sapiens; identical to SEQ ID NO: 147

SEQ ID NO: 511 - DNA, 64 bp, Homo sapiens
gatttagactaccccaaaaacgaaggggactaaaacgcgtcatgagctgcacggtggaggtgag

SEQ ID NO: 512 - DNA, 28 bp, ARTIFICIAL SEQUENCE
  Synthetic
gcgtcatgagctgcacggtggaggtgag

SEQ ID NO: 513 - DNA, 36 bp, Homo sapiens; identical to SEQ ID NO: 147

SEQ ID NO: 514 - DNA, 66 bp, ARTIFICIAL SEQUENCE
  Synthetic
tagattgctgttctaccaagtaatccatatgttgtagaagcttatcgtttggataggtatgacaac

SEQ ID NO: 515 - DNA, 30 bp, ARTIFICIAL SEQUENCE
  Synthetic
tagattgctgttctaccaagtaatccatat

SEQ ID NO: 516 - DNA, 36 bp, ARTIFICIAL SEQUENCE; identical to SEQ ID NO: 162
  Synthetic

SEQ ID NO: 517 - DNA, 64 bp, ARTIFICIAL SEQUENCE
  Synthetic
gatttagactaccccaaaaacgaaggggactaaaacgattgctgttctaccaagtaatccatat

SEQ ID NO: 518 - DNA, 28 bp, ARTIFICIAL SEQUENCE
  Synthetic
gattgctgttctaccaagtaatccatat

SEQ ID NO: 519 - DNA, 36 bp, ARTIFICIAL SEQUENCE; identical to SEQ ID NO: 147
  Synthetic

SEQ ID NO: 520 - RNA, 170 nt, Dengue virus
aguacauauucaggggccaaccucucaacaaugacgaagaccaugcucacuggacagaagcaaaaaugcugcuggacaacaucaacacaccagaagggauuauaccagcucucuuugaaccagaaagggagaagucagccgccauagacggugaauaccgccugaagggu

SEQ ID NO: 521 - DNA, 173 bp, Artificial Sequence
  Synthetic
ggccagtgaattcgagctcggtacccggggatcctctagaaatatggattacttggtagaacagcaatctactcgacctgcaggcatgcaagcttggcgtaatcatggtcatagctgtttcctgtgtttatccgctcacaattccacacaacatacgagccggaagcataaag

SEQ ID NO: 522 - RNA, 174 nt, Zika virus
gacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggc

SEQ ID NO: 523 - DNA, 190 bp, Homo sapiens
ttaattaaagcgattgatggtgatactgttaaattaatgtacaaaggtcaaccaatgacattcagactattattggttgatacacctgaaacaaagcatcctaaaaaaggtgtagagaaatatggtcctgaagcaagtgcatttacgaaaaagatggtagaaaatgcaaagaaaattgaagtcgagtttg

SEQ ID NO: 524 - DNA, 190 bp, Homo sapiens
ggggaggatgtcgggcgcgcacgttttcccttcgctgagcacgctgcgcgcgtcgcctacgtgaatgcgctgttcgatgcgttggccgaaggcaacccgcgggtgagcgtgctcgacccctccagcgtgctctgcgatggcctggattgtttcgccgaacgtgatggctggtcgctgtacatggataaca

SEQ ID NO: 525 - RNA, 173 nt, Artificial Sequence
  Synthetic
ggccagugaauucgagcucgguacccggggauccucuagaaauauggauuacuugguagaacagcaaucuacucgaccugcaggcaugcaagcuuggcguaaucauggucauagcuguuuccuguguuuauccgcucacaauuccacacaacauacgagccggaagcauaaag

SEQ ID NO: 526 - DNA, 60 bp, Artificial Sequence
  Synthetic
  misc_feature (28)..(33): n is a, c, g, or t
ttcctgtgaagctaaagaaggagaatgnnnnnntattgatagcagctgtggcacctgcac

SEQ ID NO: 527 - DNA, 182 bp, Homo sapiens
tgccagttaacgtcttccttctctctctgtcatagggactctggatcccagaaggtgagaaagttaaaattcccgtcgctatcaagacatctccgaaagccaacaaggaaatcctcgatgtgagtttctgctttgctgtgtgggggtccatggctctgaacctcaggcccaccttttctcat

SEQ ID NO: 528 - DNA, 197 bp, Homo sapiens
tgccagttaacgtcttccttctctctctgtcatagggactctggatcccagaaggtgagaaagttaaaattcccgtcgctatcaaggaattaagagaagcaacatctccgaaagccaacaaggaaatcctcgatgtgagtttctgctttgctgtgtgggggtccatggctctgaacctcaggcccaccttttctcat

SEQ ID NO: 529 - DNA, 194 bp, Homo sapiens
cctccctccaggaagcctacgtgatggccagcgtggacaacccccacgtgtgccgcctgctgggcatctgcctcacctccaccgtgcagctcatcatgcagctcatgcccttcggctgcctcctggactatgtccgggaacacaaagacaatattggctcccagtacctgctcaactggtgtgtgcagatcgca

SEQ ID NO: 530 - DNA, 194 bp, Homo sapiens
cctccctccaggaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgca

SEQ ID NO: 531 - RNA, 171 nt, Artificial Sequence
  Synthetic
uagguguuccacaggguagccagcagcauccugcgaugcaaauauggauuacuugguagaacagcaaucuaauccggaacauaauggugcagggcgcugacuuccgcguuuguuuuaaaucaaacacggaaaccgaagaccauucauguuguugcugccggaagcauaaag

SEQ ID NO: 532 - RNA, 96 nt, Artificial Sequence
  Synthetic
uagguguuccacaggguagccagcagcauccugcgaugcaaauauggauuacuugguagaacagcaaucuaauccggaacauaauggugcagggcg

SEQ ID NO: 533 - RNA, 75 nt, Artificial Sequence
  Synthetic
cugacuuccgcguuugaaaaaaaacaaacacggaaaccgaagaccauucauguuguugcugccggaagcauaaag

SEQ ID NO: 534 - DNA, 25 bp, Artificial Sequence
  Synthetic
gtacatattcaggggccaacctctc

SEQ ID NO: 535 - DNA, 50 bp, Artificial Sequence
  Synthetic
gaaattaatacgactcactataggggtacatattcaggggccaacctctc

SEQ ID NO: 536 - DNA, 25 bp, Artificial Sequence
  Synthetic
tttctggttcaaagagagctggtat

SEQ ID NO: 537 - DNA, 28 bp, Artificial Sequence
  Synthetic
tgtacaaaggtcaaccaatgacattcag

SEQ ID NO: 538 - DNA, 53 bp, Artificial Sequence
  Synthetic
gaaattaatacgactcactatagggtgtacaaaggtcaaccaatgacattcag

SEQ ID NO: 539 - DNA, 25 bp, Artificial Sequence
  Synthetic
tgcacttgcttcaggaccatatttc

SEQ ID NO: 540 - DNA, 23 bp, Artificial Sequence
  Synthetic
ctacgtgaatgcgctgttcgatg

SEQ ID NO: 541 - DNA, 48 bp, Artificial Sequence
  Synthetic
gaaattaatacgactcactatagggctacgtgaatgcgctgttcgatg

SEQ ID NO: 542 - DNA, 24 bp, Artificial Sequence
  Synthetic
gaaacaatccaggccatcgcagag

SEQ ID NO: 543 - DNA, 30 bp, Artificial Sequence
  Synthetic
tctggatcccagaaggtgagaaagttaaaa

SEQ ID NO: 544 - DNA, 55 bp, Artificial Sequence
  Synthetic
gaaattaatacgactcactatagggtctggatcccagaaggtgagaaagttaaaa

SEQ ID NO: 545 - DNA, 30 bp, Artificial Sequence
  Synthetic
ccacacagcaaagcagaaactcacatcgag

SEQ ID NO: 546 - DNA, 30 bp, Artificial Sequence; identical to SEQ ID NO: 543
  Synthetic

SEQ ID NO: 547 - DNA, 55 bp, Artificial Sequence; identical to SEQ ID NO: 544
  Synthetic

SEQ ID NO: 548 - DNA, 30 bp, Artificial Sequence; identical to SEQ ID NO: 545
  Synthetic

SEQ ID NO: 549 - DNA, 32 bp, Artificial Sequence
  Synthetic
agggccgccactccaccggcggcatggatgag

SEQ ID NO: 550 - DNA, 57 bp, Artificial Sequence
  Synthetic
gaaattaatacgactcactatagggagggccgccactccaccggcggcatggatgag

SEQ ID NO: 551 - DNA, 33 bp, Artificial Sequence
  Synthetic
gaagagttcttcacctttactcacggatcctcc

SEQ ID NO: 552 - DNA, 25 bp, Artificial Sequence
  Synthetic
ccacactggaacaacaaagaagcac

SEQ ID NO: 553 - DNA, 50 bp, Artificial Sequence
  Synthetic
gaaattaatacgactcactatagggccacactggaacaacaaagaagcac

SEQ ID NO: 554 - DNA, 30 bp, Artificial Sequence
  Synthetic
acagccttccctttgcaccatccatctcag

SEQ ID NO: 555 - DNA, 32 bp, Artificial Sequence
  Synthetic
atagtcccctcggcgaacatggacccctacaa

SEQ ID NO: 556 - DNA, 57 bp, Artificial Sequence
  Synthetic
gaaattaatacgactcactatagggatagtcccctcggcgaacatggacccctacaa

SEQ ID NO: 557 - DNA, 32 bp, Artificial Sequence
  Synthetic
gagtacgtccgcttcaccggctacccctgctc

SEQ ID NO: 558 - DNA, 34 bp, Artificial Sequence
  Synthetic
atcctctagaaatatggattacttggtagaacag

SEQ ID NO: 559 - DNA, 59 bp, Artificial Sequence
  Synthetic
aattctaatacgactcactatagggatcctctagaaatatggattacttggtagaacag

SEQ ID NO: 560 - DNA, 35 bp, Artificial Sequence
  Synthetic
gataaacacaggaaacagctatgaccatgattacg

SEQ ID NO: 561 - DNA, 30 bp, Artificial Sequence
  Synthetic
ccccacgtgtgccgcctgctgggcatctgc

SEQ ID NO: 562 - DNA, 55 bp, Artificial Sequence
  Synthetic
gaaattaatacgactcactatagggccccacgtgtgccgcctgctgggcatctgc

SEQ ID NO: 563 - DNA, 30 bp, Artificial Sequence
  Synthetic
atattgtctttgtgttcccggacatagtcc

SEQ ID NO: 564 - RNA, 14 nt, Artificial Sequence
  Synthetic
  misc_feature (1)..(1): /56-FAM/m
  misc_feature (14)..(14): /3Bio/
aauggcaaauggca

SEQ ID NO: 565 - DNA, 60 bp, Artificial Sequence; identical to SEQ ID NO: 526
  Synthetic
  misc_feature (28)..(33): n is a, c, g, or t

SEQ ID NO: 566 - RNA, 46 nt, Artificial Sequence
  Synthetic
  misc_feature (1)..(1): /5ThioMC6
  misc_feature (46)..(46): /3ThioMC3-D/
cucccuaauaacaauuuauaacuauuccuacccuuucccaaaaaaa

SEQ ID NO: 567 - DNA, 47 bp, Artificial Sequence
  Synthetic
  misc_feature (1)..(1): /5AmMC12/
  misc_feature (31)..(31): /iBiodT
  misc_feature (47)..(47): /36-FAM/
agagcatcaccatgatcctguuuuuuuutgctcggatatctcgacta

SEQ ID NO: 568 - DNA, 11 bp, Artificial Sequence
  Synthetic
  misc_feature (1)..(1): /FamCE
  misc_feature (11)..(11): /BioBB/
aaaaaaaaaaa

SEQ ID NO: 569 - DNA, 12 bp, Artificial Sequence
  Synthetic
  misc_feature (1)..(1): /56-FAM/
  misc_feature (12)..(12): /3Bio/
cccccccccccc

SEQ ID NO: 570 - DNA, 12 bp, Artificial Sequence
  Synthetic
  misc_feature (1)..(1): /56-FAM/
  misc_feature (12)..(12): /3Bio/
acacacacacac

SEQ ID NO: 571 - protein, 6 aa, Artificial Sequence
  Synthetic Peptide
  MISC_FEATURE (2)..(2): Xaa = Asn, His, or Lys
  MISC_FEATURE (3)..(3): Xaa = Arg, Ser, Asp, Glu, Gln, Asn, Gly, Tyr, or His
  MISC_FEATURE (4)..(4): Xaa = Ile, Ser, Thr, Val, or Leu
  MISC_FEATURE (5)..(5): Xaa = Leu, Phe, Asn, Tyr, Val, Ile, Ser, Asp, Glu, or Ala
RXXXXH

SEQ ID NO: 572 - protein, 6 aa, Artificial Sequence
  Synthetic Peptide
  MISC_FEATURE (2)..(2): Xaa = Asn or His
  MISC_FEATURE (3)..(3): Xaa = Arg, Ser, Asp, Glu, Gln, Asn, Gly, Tyr, or His
  MISC_FEATURE (4)..(4): Xaa = Ile, Ser, Thr, Val, or Leu
  MISC_FEATURE (5)..(5): Xaa = Leu, Phe, Asn, Tyr, Val, Ile, Ser, Asp, Glu, or A
RXXXXH

SEQ ID NO: 573 - protein, 6 aa, Artificial Sequence
  Synthetic Peptide
  MISC_FEATURE (2)..(2): Xaa = Asn or Lys
  MISC_FEATURE (3)..(3): Xaa = Leu, Phe, Asn, Tyr, Val, Ile, Ser, Asp, Glu, or A
  MISC_FEATURE (4)..(4): Xaa = Ile, Ser, Thr, Val, or Leu
  MISC_FEATURE (5)..(5): Xaa = Leu, Phe, Asn, Tyr, Val, Ile, Ser, Asp, Glu, or Ala
RXXXXH

SEQ ID NO: 574 - protein, 10 aa, Artificial Sequence
  Synthetic Peptide
  MISC_FEATURE (3)..(3): Xaa = any amino acid
  MISC_FEATURE (6)..(8): Xaa = any amino acid
DNXSTXXXRK

What is claimed is:

1. A nucleic acid detection system comprising:
   a) a detection CRISPR system comprising:
      i. a CRISPR effector protein having collateral cleavage activity,
      ii. one or more guide RNAs designed to bind to corresponding target nucleic acids, and
      iii. one or more signal amplification Type IIIa CRISPR effector proteins; and
   b) one or more RNA-based masking constructs.

2. A polypeptide detection system comprising:
   a) a detection CRISPR system comprising:
      i. a CRISPR effector protein having collateral cleavage activity,
      ii. one or more guide RNAs designed to bind to corresponding trigger RNAs, and
      iii. one or more signal amplification Type IIIa CRISPR effector proteins;
   b) one or more RNA-based masking constructs; and
   c) one or more polypeptide detection aptamers designed to bind to corresponding target polypeptides and comprising a masked RNA polymerase promoter binding site or a masked primer binding site.

3. The system of claim 1, wherein the system further comprises nucleic acid amplification reagents.

4. The system of claim 1, wherein the signal amplification Type IIIa CRISPR protein is a Csm6 protein.

5. The system of claim 1, wherein the one or more signal amplification Type IIIa CRISPR effector proteins comprises one or more of Csm6, Csx28, Csx27 or any combination thereof.

6. The system of claim 1, wherein the target nucleic acid is a target DNA and the system further comprises a primer that binds the target DNA and comprises an RNA polymerase promoter.

7. The system of claim 1, wherein the CRISPR effector protein having collateral cleavage activity is CRISPR RNA-targeting effector protein; wherein the CRISPR RNA-targeting effector protein optionally comprises one or more HEPN domains; wherein the one or more HEPN domains optionally comprise a RxxxxH motif sequence; wherein the RxxxxH motif sequence optionally comprises a R{N/H/K}X1X2X3H sequence; and wherein X1 is R, S, D, E, Q, N, G, or Y, and X2 is independently I, S, T, V, or L, and X3 is independently L, F, N, Y, V, I, S, D, E, or A.

8. The system of claim 7, wherein the CRISPR RNA-targeting effector protein is C2c2 or Cas13b, and wherein the C2c2 is within 20 kb of a Cas 1 gene.

9. The system of claim 8, wherein the C2c2 effector protein is from an organism of a genus selected from the group consisting of: *Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma, Campylobacter*, and *Lachnospira*;

wherein the C2c2 effector protein is optionally from an organism selected from the group consisting of: *Leptotrichia shahii; Leptotrichia wadei* (Lw2); *Listeria seeligeri; Lachnospiraceae bacterium* MA2020; *Lachnospiraceae bacterium* NK4A179; [*Clostridium*] *aminophilum* DSM 10710; *Carnobacterium gallinarum* DSM 4847; *Carnobacterium gallinarum* DSM 4847 (second CRISPR Loci); *Paludibacter propionicigenes* WB4; *Listeria weihenstephanensis* FSL R9-0317; *Listeriaceae bacterium* FSL M6-0635; *Leptotrichia wadei* F0279; *Rhodobacter capsulatus* SB 1003; *Rhodobacter capsulatus* R121; *Rhodobacter capsulatus* DE442; *Leptotrichia buccalis* C-1013-b; *Herbinix hemicellulosilytica;* [*Eubacterium*] *rectale; Eubacteriaceae bacterium* CHKCI004; *Blautia* sp. Marseille-P2398; *Leptotrichia* sp. oral taxon 879 str. F0557; *Lachnospiraceae bacterium* NK4A144; *Chloroflexus aggregans; Demequina aurantiaca; Thalassospira* sp. TSL5-1; *Pseudobutyrivibrio* sp. OR37; *Butyrivibrio* sp. YAB3001; *Blautia* sp. Marseille-P2398; *Leptotrichia* sp. Marseille-P3007; *Bacteroides ihuae; Porphyromonadaceae bacterium* KH3CP3RA; *Listeria riparia*; and *Insolitispirillum peregrinum*;

wherein the C2c2 effector protein is optionally a *L. wadei* F0279 or *L. wadei* F0279 (Lw2) C2c2 effector protein.

10. The system of claim 1, wherein the one or more RNA-based masking constructs suppresses generation of a detectable positive signal; and
   wherein the one or more RNA-based masking constructs optionally suppresses generation of a detectable positive signal by masking the detectable positive signal, or generating a detectable negative signal instead; or
   wherein the one or more RNA-based masking constructs optionally comprises a silencing RNA that suppresses generation of a gene product encoded by a reporting construct, wherein the gene product generates the detectable positive signal when expressed.

11. The system of claim 10, wherein the one or more RNA-based masking constructs is a ribozyme that generates the negative detectable signal, and wherein the positive detectable signal is generated when the ribozyme is deactivated, optionally wherein the ribozyme converts a substrate to a first color and wherein the substrate converts to a second color when the ribozyme is deactivated.

12. The system of claim 10, wherein the RNA-based masking construct is an RNA aptamer and/or comprises an RNA-tethered inhibitor.

13. The system of claim 12, wherein the aptamer or RNA-tethered inhibitor sequesters an enzyme, wherein the enzyme generates a detectable signal upon release from the aptamer or RNA tethered inhibitor by acting upon a substrate; or wherein the aptamer is an inhibitory aptamer that inhibits an enzyme and prevents the enzyme from catalyzing generation of a detectable signal from a substrate or wherein the RNA-tethered inhibitor inhibits an enzyme and prevents the enzyme from catalyzing generation of a detectable signal from a substrate; and wherein the enzyme is optionally thrombin, protein C, neutrophil elastase, subtilisin, horseradish peroxidase, beta-galactosidase, or calf alkaline phosphatase or wherein the enzyme is optionally thrombin and the substrate is para-nitroanilide covalently linked to a peptide substrate for thrombin, or 7-amino-4-methyl-coumarin covalently linked to a peptide substrate for thrombin.

14. The system of claim 12, wherein the aptamer sequesters a pair of agents that when released from the aptamers combine to generate a detectable signal.

15. The system of claim 10, wherein the one or more RNA-based masking constructs comprises an RNA oligonucleotide to which a detectable ligand and a masking component are attached; or wherein the one or more RNA-based masking constructs comprises a nanoparticle held in aggregate by bridge molecules, wherein at least a portion of the bridge molecules comprises RNA, wherein the solution undergoes a color shift when the nanoparticle is disbursed in solution; wherein the nanoparticle is optionally a colloidal metal such as colloidal gold; or wherein the detectable ligand is a fluorophore and the masking component is a quencher molecule.

16. The system of claim 10, wherein the one or more RNA-based masking constructs comprises a quantum dot linked to one or more quencher molecules by a linking molecule, wherein at least a portion of the linking molecule comprises RNA.

17. The system of claim 10, wherein the one or more RNA-based masking constructs comprises RNA in complex with an intercalating agent, wherein the intercalating agent changes absorbance upon cleavage of the RNA; wherein the intercalating agent is optionally pyronine-Y or methylene blue.

18. The system of claim 1, wherein the one or more RNA-based masking constructs comprises a RNA-based masking construct that can be cleaved by the CRISPR effector protein having collateral cleavage activity and a RNA-based masking construct that can be cleaved by the signal amplification Type IIIa CRISPR protein; or wherein the one or more RNA-based masking constructs comprise an RNA-based masking construct that can be cleaved by the CRISPR RNA-targeting effector protein and Type IIIa CRISPR protein.

19. The system of claim 18,
wherein the RNA-based masking construct that can be cleaved by the Type IIIa CRISPR protein comprises homopolymeric A-RNA or C-RNA.

20. The system of claim 1, wherein the one or more guide RNAs designed to bind to corresponding target nucleic acids comprise a (synthetic) mismatch; and wherein said mismatch is optionally up- or downstream of a SNP or other single nucleotide variation in said target nucleic acid, optionally 1, 2, 3, 4, or 5 nucleotides upstream or downstream, optionally 2 nucleotides, optionally downstream of said SNP or other single nucleotide variation in said guide RNA; or wherein the synthetic mismatch in said guide RNA is optionally at position 1, 2, 3, 4, 5, 6, 7, 8, or 9 of the spacer, optionally position 3 or position 5.

21. The system of claim 1, wherein the one or more guide RNAs are designed to detect a single nucleotide polymorphism in a target RNA or DNA, or a splice variant of an RNA transcript.

22. The system of claim 1, wherein the system further comprises one or more activation sequences, and wherein each activation sequence optionally comprises a poly A stretch, or optionally produces hexadenylates containing a 2'3' cyclic phosphate end when cleaved by the CRISPR RNA-targeting effector protein.

23. The system of claim 1, wherein the one or more guide RNAs are designed to bind to one or more target nucleic acids that are diagnostic for a disease state; wherein the disease state is optionally cancer, an autoimmune disease, or an infection; and wherein the infection is optionally caused by a virus, a bacterium, a fungus, a protozoan, or a parasite.

24. The system of claim 23, wherein the infection is a viral infection; and wherein the viral infection is optionally caused by a DNA virus, a double-stranded RNA virus, a positive sense RNA virus, a negative sense RNA virus, a retrovirus, or a combination thereof.

25. The system of claim 24, wherein the DNA virus is a Myoviridae, Podoviridae, Siphoviridae, Alloherpesviridae, Herpesviridae (including human herpes virus, and Varicella Zoster virus), Malocoherpesviridae, Lipotrixviridae, Rudiviridae, Adenoviridae, Ampullaviridae, Ascoviridae, Asfarviridae (including African swine fever virus), Baculoviridae, Cicaudaviridae, Clavaviridae, Corticoviridae, Fuselloviridae, Globuloviridae, Guttaviridae, Hytrosaviridae, Iridoviridae, Maseilleviridae, Mimiviridae, Nudiviridae, Nimaviridae, Pandoraviridae, Papillomaviridae, Phycodnaviridae, Plasmaviridae, Polydnaviruses, Polyomaviridae (including Simian virus 40, JC virus, BK virus), Poxviridae (including Cowpox and smallpox), Sphaerolipoviridae, Tectiviridae, Turriviridae, Dinodnavirus, Salterprovirus, Rhizidovirus.

26. The system of claim 24, wherein the viral infection is caused by a Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus; wherein the viral infection is optionally caused by Coronavirus, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus.

27. The system of claim 23, wherein the infection is a bacterial infection; wherein the bacterium causing the bacterial infection is optionally *Acinetobacter* species, *Actinobacillus* species, *Actinomycetes* species, an *Actinomyces* species, *Aerococcus* species an *Aeromonas* species, an *Anaplasma* species, an *Alcaligenes* species, a *Bacillus* species, a *Bacteroides* species, a *Bartonella* species, a *Bifidobacterium* species, a *Bordetella* species, a *Borrelia* species, a *Brucella* species, a *Burkholderia* species, a *Campylobacter* species, a *Capnocytophaga* species, a *Chlamydia* species, a *Citrobacter* species, a *Coxiella* species, a *Corynbacterium* species, a *Clostridium* species, an *Eikenella* species, an *Enterobacter* species, an *Escherichia* species, an *Enterococ-* cus species, an *Ehlichia* species, an *Epidermophyton* species, an *Erysipelothrix* species, a *Eubacterium* species, a *Francisella* species, a *Fusobacterium* species, a *Gardnerella* species, a *Gemella* species, a *Haemophilus* species, a *Helicobacter* species, a *Kingella* species, a *Klebsiella* species, a *Lactobacillus* species, a *Lactococcus* species, a *Listeria* species, a *Leptospira* species, a *Legionella* species, a *Leptospira* species, *Leuconostoc* species, a *Mannheimia* species, a *Microsporum* species, a *Micrococcus* species, a *Moraxella* species, a *Morganell* species, a *Mobiluncus* species, a *Micrococcus* species, *Mycobacterium* species, a *Mycoplasm* species, a *Nocardia* species, a *Neisseria* species, a *Pasteurelaa* species, a *Pediococcus* species, a *Peptostreptococcus* species, a *Pityrosporum* species, a *Plesiomonas* species, a *Prevotella* species, a *Porphyromonas* species, a *Proteus* species, a *Providencia* species, a *Pseudomonas* species, a *Propionibacteriums* species, a *Rhodococcus* species, a *Rickettsia* species, a *Rhodococcus* species, a *Serratia* species, a *Stenotrophomonas* species, a *Salmonella* species, a *Serratia* species, a *Shigella* species, a *Staphylococcus* species, a *Streptococcus* species, a *Spirillum* species, a *Streptobacillus* species, a *Treponema* species, a *Tropheryma* species, a *Trichophyton* species, an *Ureaplasma* species, a *Veillonella* species, a *Vibrio* species, a *Yersinia* species, a *Xanthomonas* species, or combination thereof.

28. The system of claim 23, wherein the infection is caused by a fungus; wherein the fungus is optionally *Aspergillus, Blastomyces, Candidiasis, Coccidiodomycosis, Cryptococcus neoformans, Cryptococcus gatti*, sp. *Histoplasma* sp. (such as *Histoplasma capsulatum*), *Pneumocystis* sp. (such as *Pneumocystis jirovecii*), *Stachybotrys* (such as *Stachybotrys chartarum*), *Mucroymcosis, Sporothrix*, fungal eye infections ringworm, *Exserohilum, Cladosporium, Geotrichum, Saccharomyces*, a *Hansenula* species, a *Candida species*, a *Kluyveromyces* species, a *Debaryomyces* species, a *Pichia* species, a *Penicillium* species, a *Cladosporium* species, a *Byssochlamys* species or a combination thereof.

29. The system of claim 23, wherein the infection is caused by a protozoan; wherein the protozoan is optionally Euglenozoa, a Heterolobosea, a Diplomonadida, an *Amoebozoa*, a *Blastocystic*, an *Apicomplexa*, or combination thereof.

30. The system of claim 23, wherein the infection is caused by a parasite; wherein the parasite is optionally *Trypanosoma cruzi* (Chagas disease), *T. brucei gambiense, T. brucei rhodesiense, Leishmania braziliensis, L. infantum, L. mexicana, L. major, L. tropica, L. donovani, Naegleria fowleri, Giardia intestinalis (G. lamblia, G. duodenalis), canthamoeba castellanii, Balamuthia madrillaris, Entamoeba histolytica, Blastocystic hominis, Babesia microti, Cryptosporidium parvum, Cyclospora cayetanensis, Plasmodium falciparum, P. vivax, P. ovale, P. malariae*, and *Toxoplasma gondii*, or combination thereof.

31. The system of claim 3, wherein the reagents to amplify nucleic acids comprise nucleic acid sequence-based amplification (NASBA), recombinase polymerase amplification (RPA), loop-mediated isothermal amplification (LAMP), strand displacement amplification (SDA), helicase-dependent amplification (HDA), nicking enzyme amplification reaction (NEAR), PCR, multiple displacement amplification (MDA), rolling circle amplification (RCA), ligase chain reaction (LCR), or ramification amplification method (RAM).

32. The system of claim 1, further comprising an enrichment CRISPR system, wherein the enrichment CRISPR system is designed to bind the corresponding target nucleic acids prior to detection by the detection CRISPR system; wherein the enrichment CRISPR system optionally comprises a catalytically inactive CRISPR effector protein; wherein the catalytically inactive CRISPR effector protein is optionally a catalytically inactive C2c2.

33. The system of claim 32, wherein the enrichment CRISPR effector protein further comprises a tag, wherein the tag is used to pull down the enrichment CRISPR effector system, or to bind the enrichment CRISPR system to a solid substrate; wherein the solid substrate is optionally a flow cell.

34. A diagnostic device comprising one or more individual discrete volumes, each individual discrete volume comprising the nucleic acid detection system of claim 1.

35. The diagnostic device of claim 34, wherein each individual discrete volume further comprises nucleic acid amplification reagents; and/or one or more polypeptide detection aptamers designed to bind to corresponding target polypeptides and comprising a masked RNA polymerase promoter binding site or a masked primer binding site.

36. The device of claim 34, wherein the target nucleic acid is a target DNA and the individual discrete volumes further comprise a primer that binds the target DNA and comprises an RNA polymerase promoter.

37. The device of claim 34, wherein the individual discrete volumes are droplets; wherein the individual discrete volumes are optionally defined on a solid substrate; and wherein they are optionally microwells.

38. The diagnostic device of claim 34, wherein the individual discrete volumes are spots defined on a substrate; wherein the substrate is optionally a flexible materials substrate such as a paper substrate or a flexible polymer based substrate.

39. A method for detecting target nucleic acids in samples, comprising:
  distributing a sample or set of samples into one or more individual discrete volumes, the individual discrete volumes comprising the nucleic acid detection system of claim 1;
  incubating the sample or set of samples under conditions sufficient to allow binding of the one or more guide RNAs to one or more target nucleic acids;
  activating the CRISPR effector protein having collateral cleavage activity via binding of the one or more guide RNAs to the one or more target nucleic acids, wherein activating the CRISPR effector protein results in modification of the RNA-based masking construct such that a detectable positive signal is generated; and
  detecting the detectable positive signal, wherein detection of the detectable positive signal indicates a presence of one or more target nucleic acids in the sample or set of samples.

40. A method for detecting polypeptides in samples, comprising:
  distributing a sample or set of samples into a set of individual discrete volumes, the individual discrete volumes comprising the polypeptide detection system of claim 2;
  incubating the sample or set of samples under conditions sufficient to allow binding of the peptide detection aptamers to one or more target polypeptides, wherein binding of the aptamers to corresponding target polypeptides exposes the RNA polymerase binding sites or primer binding sites resulting in generation of one or more trigger RNAs;
  activating the CRISPR effector protein having collateral cleavage activity via binding of the one or more guide RNAs to the one or more trigger RNAs, wherein activating the CRISPR effector protein results in modification of the RNA-based masking construct such that a detectable positive signal is produced; and detecting the detectable positive signal, wherein detection of the detectable positive signal indicates a presence of one or more target polypeptides in a sample.

41. The method of claim 39, wherein the target nucleic acid is a target DNA and the method further comprises binding the target DNA with a primer comprising an RNA polymerase site; and wherein the method optionally further comprises amplifying the sample RNA, wherein amplifying the sample RNA optionally comprises amplification by NASBA or RPA.

42. The method of claim 39, wherein the sample is a biological sample or an environmental sample;
wherein the biological sample is optionally a blood, plasma, serum, urine, stool, sputum, mucous, lymph fluid, synovial fluid, bile, ascites, pleural effusion, seroma, saliva, cerebrospinal fluid, aqueous or vitreous humor, or any bodily secretion, a transudate, an exudate (for example, fluid obtained from an abscess or any other site of infection or inflammation), or fluid obtained from a joint (for example, a normal joint or a joint affected by disease, such as rheumatoid arthritis, osteoarthritis, gout or septic arthritis), or a swab of skin or mucosal membrane surface; and
wherein the environmental sample is optionally obtained from a food sample, paper surface, a fabric, a metal surface, a wood surface, a plastic surface, a soil sample, a fresh water sample, a waste water sample, a saline water sample, or a combination thereof.

43. The method of claim 39, wherein the one or more guide RNAs are designed to detect a single nucleotide polymorphism in a target RNA or DNA, or a splice variant of an RNA transcript.

44. The method of claim 39, wherein the one or more guide RNAs are designed to bind to one or more target nucleic acids that are diagnostic for a disease state; wherein the disease state is optionally an infection, an organ disease, a blood disease, an immune system disease, a cancer, a brain and nervous system disease, an endocrine disease, a pregnancy or childbirth-related disease, an inherited disease, or an environmentally-acquired disease; wherein the disease state is optionally characterized by the presence or absence of an antibiotic or drug resistance or susceptibility gene or transcript or polypeptide, preferably in a pathogen or a cell; and wherein said nucleic acid is optionally an antibiotic or drug resistance or susceptibility gene or transcript.

45. The method of claim 39, wherein the one or more guide RNAs are designed to bind to cell free nucleic acids; and wherein the method optionally further comprises comparing the detectable positive signal with a standard, optionally synthetic, signal.

46. The system of claim 1, wherein said guide RNA comprises a spacer which is truncated relative to a wild type spacer; or
wherein the spacer comprises less than 28 nucleotides, optionally between and including 20 to 27 nucleotides; or
wherein the spacer consists of 20-25 nucleotides or 20-23 nucleotides, optionally 20 or 23 nucleotides.

47. The system of claim 1, wherein said RNA-based masking construct comprises an RNA oligonucleotide designed to bind a G-quadruplex forming sequence, wherein a G-quadruplex structure is formed by the G-quadruplex forming sequence upon cleavage of the masking construct, and wherein the G-quadruplex structure generates a detectable positive signal.

48. A method for detecting a target nucleic acid in a sample, comprising:
contacting a sample with the nucleic acid detection system according to claim 1; and
applying said contacted sample to a lateral flow immunochromatographic assay.

49. The method according to claim 48, wherein said nucleic acid detection system comprises an RNA-based masking construct comprising a first and a second molecule, and wherein said lateral flow immunochromatographic assay comprises detecting said first and second molecule, optionally at discrete detection sites on a lateral flow strip; wherein said first molecule and said second molecule are optionally detected by binding to an antibody recognizing said first or second molecule and detecting said bound molecule, preferably with sandwich antibodies; and wherein said lateral flow strip optionally comprises an upstream first antibody directed against said first molecule, and a downstream second antibody directed against said second molecule, and wherein uncleaved RNA-based masking construct is bound by said first antibody if the target nucleic acid is not present in said sample, and wherein cleaved RNA-based masking construct is bound both by said first antibody and said second antibody if the target nucleic acid is present in said sample.

50. The system of claim 4, wherein the Csm6 protein is EiCsm6 or LsCsm6.

51. The system of claim 8, wherein the Cas13b effector protein is from an organism of a genus selected from the group consisting of: *Alistipes*, *Bacteroides*, *Bergeyella*, *Capnocytophaga*, *Chryseobacterium*, *Flavobacterium*, *Myroides*, *Paludibacter*, *Phaeodactylibacter*, *Porphyromonas*, *Prevotella*, *Psychroflexus*, *Reichenbachiella*, *Riemerella*, and *Sinomicrobium*.

52. The system of claim 8, wherein the Cas13b effector protein is from an organism selected from the group consisting of: *Alistipes* sp. ZOR0009, *Bacteroides pyogenes*, *Bacteroidetes bacterium* GWA2_31_9, *Bergeyella zoohelcum*, *Capnocytophaga canimorsus*, *Capnocytophaga cynodegmi*, *Chryseobacterium carnipullorum*, *Chryseobacterium jejuense*, *Chryseobacterium ureilyticum*, *Chryseobacterium* sp. YR477, *Flavobacterium branchiophilum*, *Flavobacterium columnare*, *Flavobacterium* sp. 316, *Myroides odoratimimus*, *Paludibacter propionicigenes*, *Phaeodactylibacter xiamenensis*, *Porphyromonas gingivalis*, *Porphyromonas gulae*, *Porphyromonas* sp. COT-052 OH4946, *Prevotella aurantiaca*, *Prevotella buccae*, *Prevotella falsenii*, *Prevotella intermedia*, *Prevotella pallens*, *Prevotella pleuritidis*, *Prevotella saccharolytica*, *Prevotella* sp. MA2016, *Prevotella* sp. MSX73, *Prevotella* sp. P5-125, *Prevotella* sp. P5-119, *Prevotella* sp. P4-76, *Prevotella* sp. P5-60, *Psychroflexus torquis*, *Reichenbachiella agariperforans*, *Riemerella anatipestifer*, and *Sinomicrobium oceani*.

53. The system of claim 8, wherein the Cas13b effector protein is a *Capnocytophaga canimorsus* Cc5, *Prevotella buccae* ATCC 33574, *Prevotella pallens* ATCC 700821, *Myroides odoratimimus* CCUG 12901, *Myroides odoratimimus* CCUG 3837, *Bergeyella zoohelcum* ATCC 43767, *Prevotella saccharolytica* F0055, *Porphyromonas gingivalis* JCVI SC001, *Bacteroides pyogenes* F0041, *Porphyromonas gingivalis* F0568, *Porphyromonas gingivalis* F0185, *Porphyromonas gingivalis* W4087, *Prevotella intermedia* ZT, *Myroides odoratimimus* CCUG 10230, or *Prevotella intermedia* 17 Cas13b effector protein.

\* \* \* \* \*

UNITED STATES PATENT AND TRADEMARK OFFICE
CERTIFICATE OF CORRECTION

| | | |
|---|---|---|
| PATENT NO. | : 11,898,142 B2 | Page 1 of 7 |
| APPLICATION NO. | : 16/645571 | |
| DATED | : February 13, 2024 | |
| INVENTOR(S) | : Feng Zhang et al. | |

It is certified that error appears in the above-identified patent and that said Letters Patent is hereby corrected as shown below:

On the Title Page

Item (73), in Column 1, in "Assignee", Line 4, after "Fellows" insert -- of --.

In the Drawings

Figure 7:
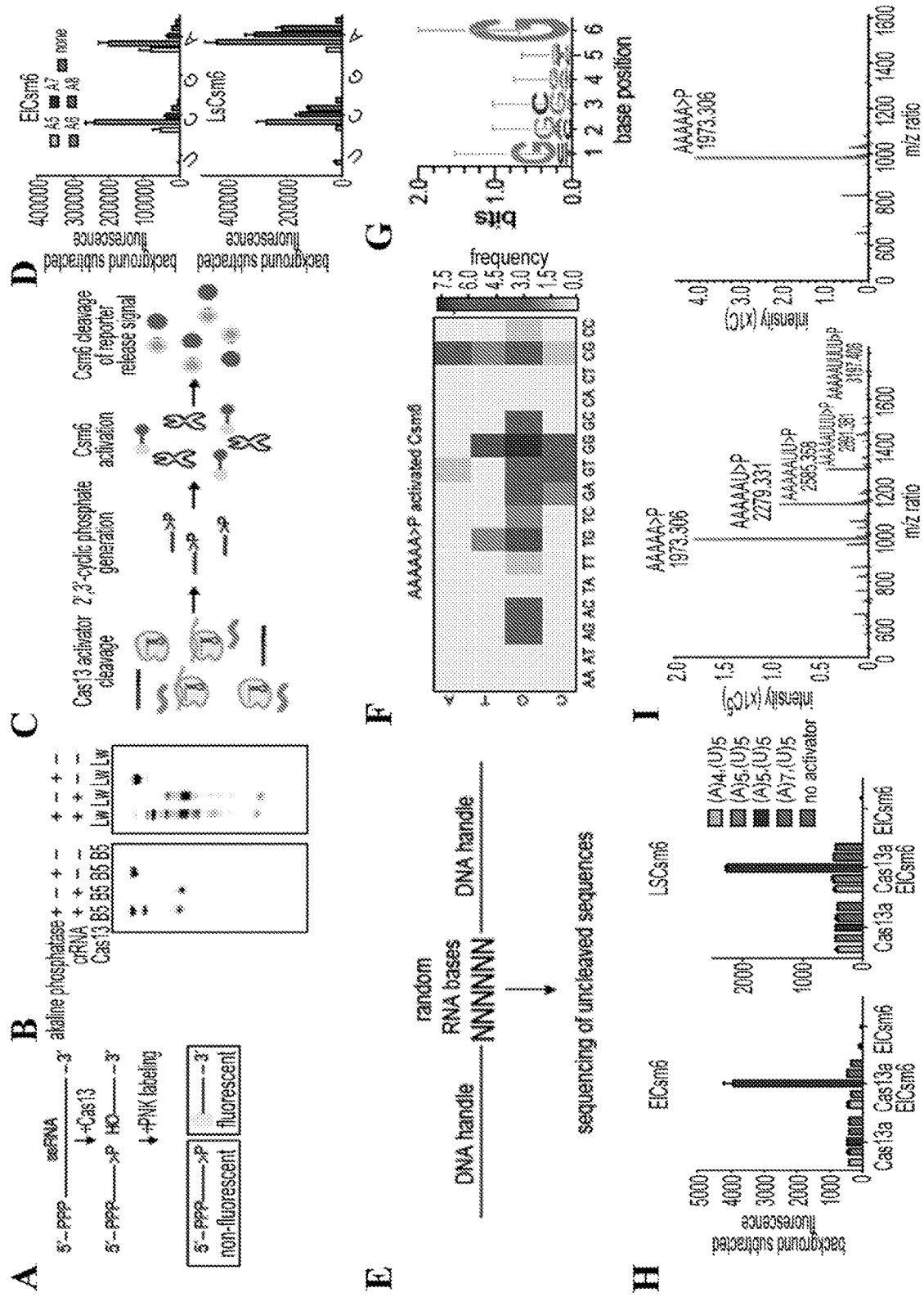
FIG. 7—Enhanced SHERLOCK signal via Csm6 positive feedback. (A) Schematic for detection of 2,3 cyclic phosphate ends via PNK labeling and gel electrophoresis. (B) Electrophoresis gel demonstrating 2,3 cyclic phosphate ends generated by LwaCas13a or PsmCas13b cleavage of ssRNA target 2 (homopolymer loops). The Cas13 enzyme is incubated with the appropriate crRNA targeting the ssRNA target and the cleavage products are 5' labeled with a dye IR800 with or without alkaline phosphatase treatment. (C) Schematic for Csm6-mediated positive feedback in a SHERLOCK reaction. (D) Activation of two Csm6 orthologs via 2,3 cyclic phosphate-terminated adenine oligomers of different lengths. Csm6 cleavage is measured using an RNA sensor consisting of A, C, G, or U hexa-homopolymers with ends labeled with a fluorophore and quencher. (E) Activation of two Csm6 orthologs via LwaCas13a cleavage of adenine-uridine activators with different length adenine tracts. LwaCas13a is targeting synthetic Dengue sRNA. (F) Mass spectrometry analysis of digestion products from LwaCas13a collateral cleavage (left) or 2,3 cyclic phosphate activator alone (right). Dominant peaks are labeled with mass and corresponding structure. (G) Schematic of cleavage motif preference discovery screen for Csm6 orthologs. (H) Heatmap of preferred 3-base motifs for EiCsm6 cleavage activity. Values represented in the heatmap are the counts of each 3-base across all depleted motifs. Motifs are considered depleted if the $-\log_2$(target/no target) value is above 0.5. In the $-\log_2$(target/no target) value, target and no target denote the frequency of a motif in the target and no target conditions, respectively. (I) Sequence logo of preferred sequence motif for EiCsm6 cleavage activity. (J) Combined LwaCas13a and EiCsm6 signal for increasing concentrations of $(A)_6$-$(U)_5$ activator detecting 20 nM of Dengue ssRNA. (K) EiCsm6-enhanced LwaCas13a SHERLOCK detection of P. aerunoginosa acyltransferase synthetic target in combination with LwaCas13a. (L) Kinetics of EiCsm6-enhanced LwaCas13a SHERLOCK detection of P. aerunoginosa acyltransferase synthetic target. (M) EiCsm6-enhanced lateral flow detection of synthetic Dengue RNA in combination with LwaCas13a without preamplification by RPA. Band intensity quantitation is shown to the right. (N) EiCsm6-enhanced lateral flow SHERLOCK of P. aerunoginosa acyltransferase gene in combination with LwaCas13a. Band intensity quantitation is shown to the right.
Figure 7:
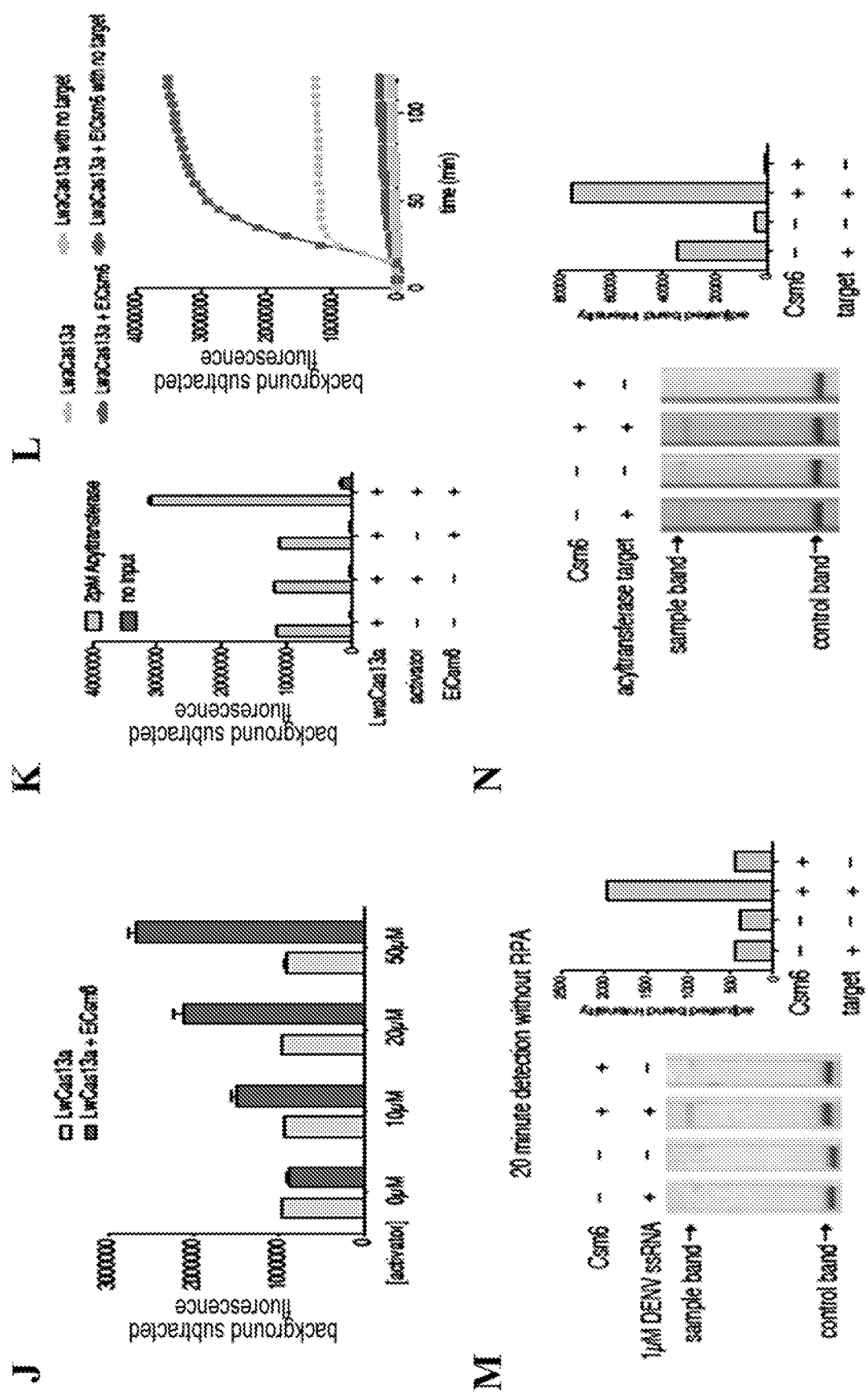
Figure 8:
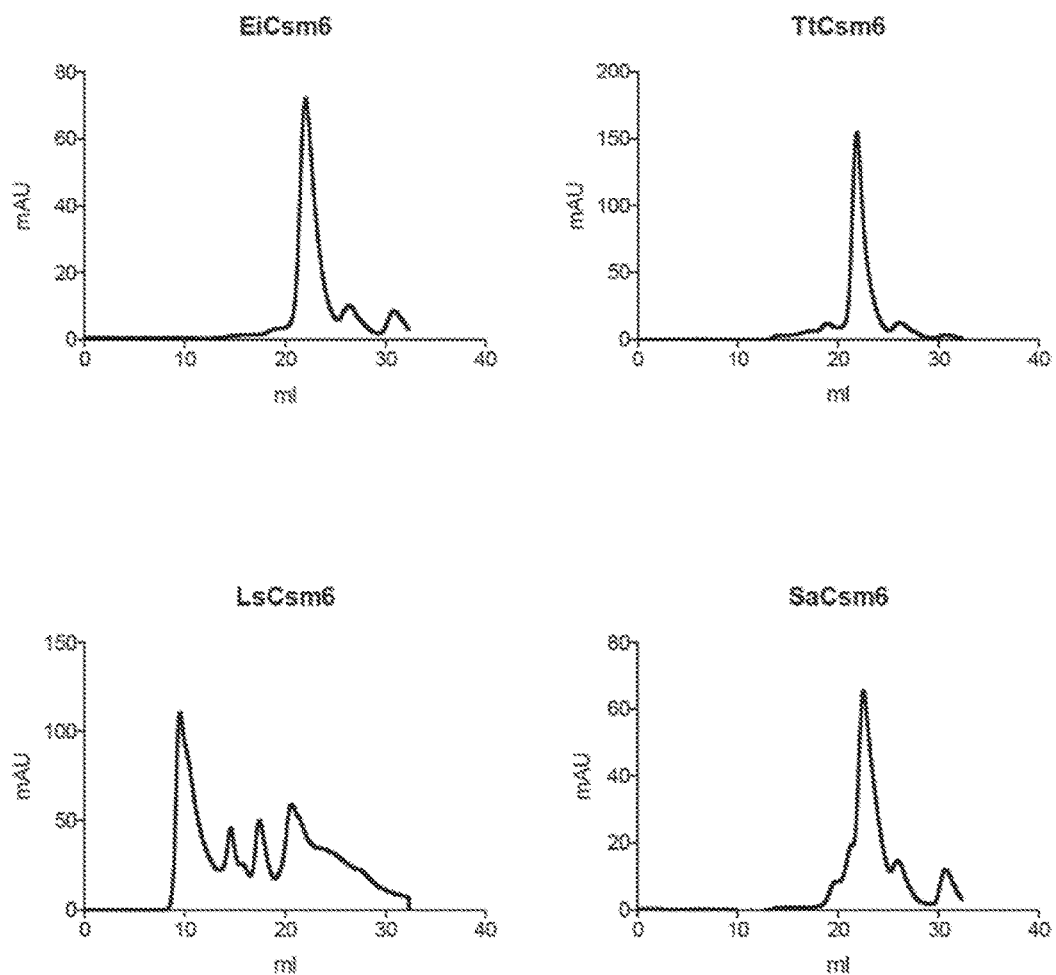
FIG. 8—Protein purification of Csm6 orthologs. (A) Chromatograms of size exclusion chromatography for EiCsm6, TtCsm6, LsCsm6 and SaCsm6 used in this study. Measured UV absorbance (mAU) is shown against the elution volume (ml). (B) SDS-PAGE gel of EiCsm6, TtCsm6 and LsCsm6 fractions prior to size exclusion chromatography. Fractions show the bacterial lysate supernatant (1) after streptactin incubation, streptactin resins after cleavage with SUMO protease (2), as well as released, untagged Csm6 protein (3). (C) Final SDS-PAGE of concentrated Csm6 proteins after size exclusion chromatography. BSA standard curve (left) is used to quantify Csm6 proteins (right). Five dilutions of BSA and two dilutions of EiCsm6, TtCsm6 and LsCsm6 are shown.
Figure 8:
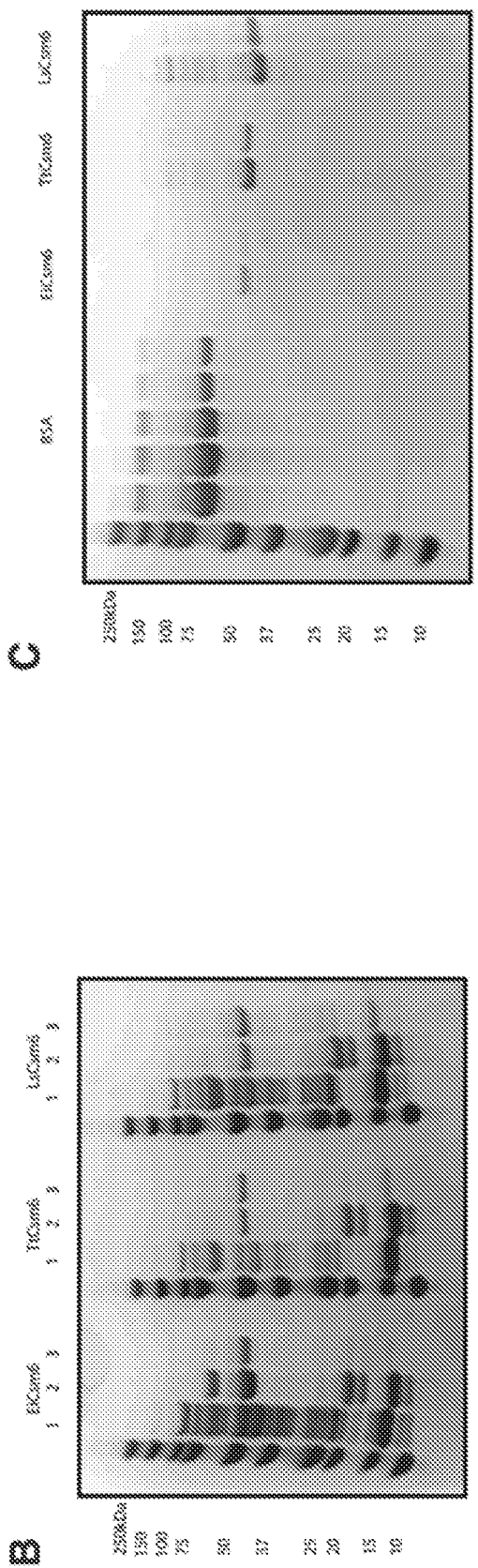
Figure 9:
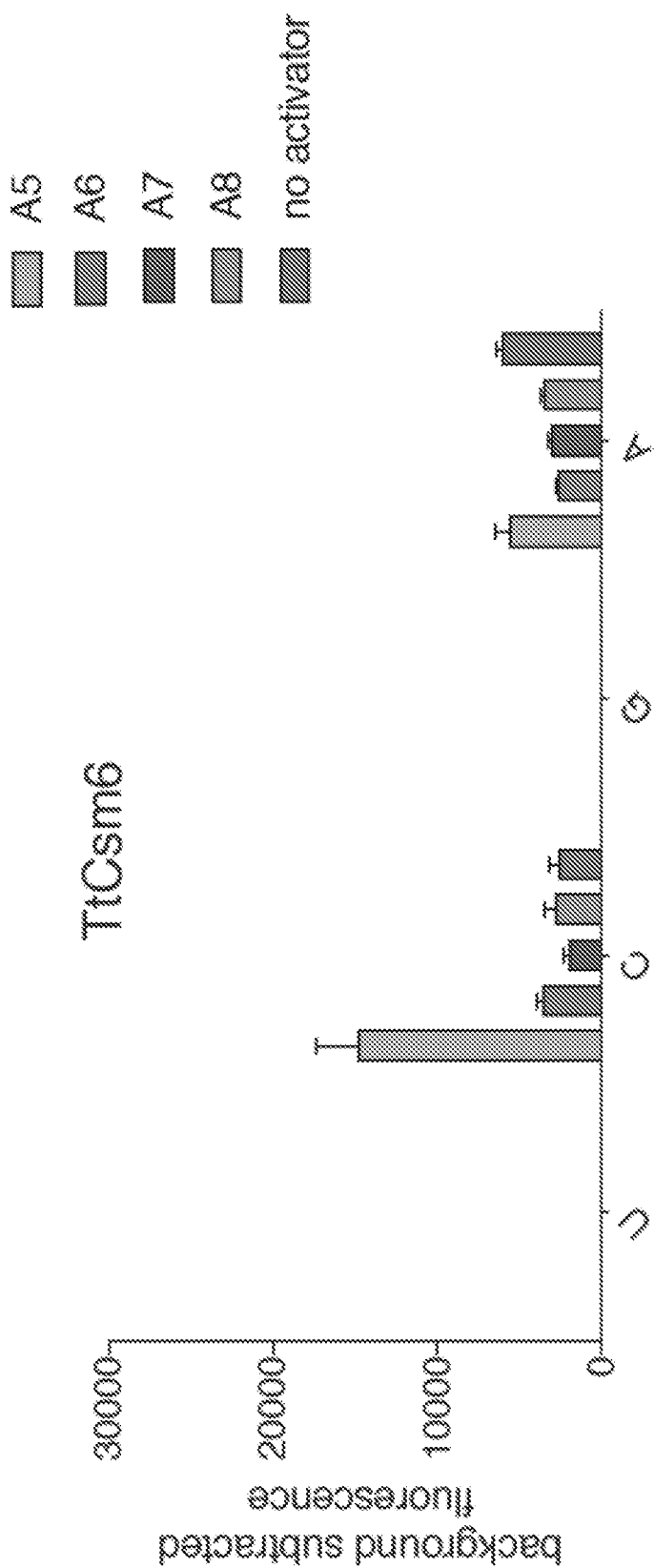
FIG. 9—Base preference of TtCsm6 cleavage using activators of different length with 3' 2,3 cyclic phosphate ends.

On sheet 8 of 53, In FIG. 7, Line 2, delete "akaline" and insert -- alkaline --.

In the Specification

In Column 1, Line 20, delete "(BROD_2277US_ST25.txt," and insert
-- ("BROD_2277US_ST25.txt," --.

In Column 1, Lines 24-30, delete "STATEMENT REGARDING FEDERALLY SPONSORED RESEARCH
This invention was made with government support under grant number MH110049 granted by the National Institutes of Health. The government has certain rights in the invention." and insert
-- STATEMENT REGARDING FEDERALLY SPONSORED RESEARCH
This invention was made with government support under Grant Nos. MH100706 and MH110049 awarded by the National Institutes of Health. The government has certain rights in the invention. --.

In Column 2, Line 34, delete "RxxxH" and insert -- RxxxxH --.

In Column 2, Line 35, delete "R{N/H/K]" and insert -- R{N/H/K} --.

In Column 2, Line 42, delete "Corynebacter," and insert -- Corynebacterium, --.

In Column 4, Lines 46-47, delete "Malocoherpesviridae," and insert -- Malacoherpesviridae, --.

In Column 4, Line 51, delete "Maseilleviridae," and insert -- Marseilleviridae, --.

Signed and Sealed this
Sixth Day of August, 2024

Katherine Kelly Vidal
*Director of the United States Patent and Trademark Office*

CERTIFICATE OF CORRECTION (continued)
U.S. Pat. No. 11,898,142 B2

In Column 5, Line 12, delete "Aerococcus species" and insert -- Aerococcus species, --.

In Column 5, Line 19, delete "Corynbacterium" and insert -- Corynebacterium --.

In Column 5, Line 21, delete "Ehlichia" and insert -- Ehrlichia --.

In Column 5, Line 31, delete "Morganell" and insert -- Morganella --.

In Column 5, Line 32, delete "Mycoplasm" and insert -- Mycoplasma --.

In Column 5, Lines 37-38, delete "Propionibacteriums" and insert -- Propionibacterium --.

In Column 5, Line 49, delete "Coccidiodomycosis," and insert -- Coccidioidomycosis, --.

In Column 5, Line 50, delete "gatti," and insert -- gattii, --.

In Column 5, Line 53, delete "Mucroymcosis," and insert -- Mucormycosis, --.

In Column 6, Line 1, delete "canthamoeba" and insert -- acanthamoeba --.

In Column 6, Line 2, delete "madrillaris," and insert -- mandrillaris, --.

In Column 9, Line 53, delete "aerunoginosa" and insert -- aeruginosa --.

In Column 9, Line 56, delete "aerunoginosa" and insert -- aeruginosa --.

In Column 9, Line 61, delete "aerunoginosa" and insert -- aeruginosa --.

In Column 11, Line 35, delete "–log 2" and insert -- $-\log_2$ --.

In Column 12, Line 58, delete "aerunoginosa" and insert -- aeruginosa --.

In Column 14, Line 19, delete "–log 2" and insert -- –log2 --.

In Column 14, Line 20, delete "–log 2" and insert -- –log2 --.

In Column 14, Line 28, delete "–log 2" and insert -- –log2 --.

In Column 14, Lines 28-29, delete "–log 2" and insert -- –log2 --.

In Column 14, Line 34, delete "–log 2" and insert -- –log2 --.

In Column 14, Line 35, delete "–log 2" and insert -- –log2 --.

In Column 15, Line 31, delete "aerunoginosa" and insert -- aeruginosa --.

CERTIFICATE OF CORRECTION (continued)
U.S. Pat. No. 11,898,142 B2

In Column 21, Line 53, delete "10/1038/nature19802" and insert -- 10/1038/nature19802 --.

In Column 22, Line 5, delete "Corynebacter," and insert -- Corynebacterium, --.

In Column 22, Line 34, delete "Corynebacter," and insert -- Corynebacterium, --.

In Column 23, Line 24, delete "Corynebacter," and insert -- Corynebacterium, --.

In Column 24, Line 44, delete "hemicellulosilytics" and insert -- hemicellulosilytica --.

In Columns 25-26, Line 16, delete "Leptorichia" and insert -- Leptotrichia --.

In Column 25, Line 66, delete "1335;" and insert -- I335; --.

In Column 25, Line 67, delete "1466; 1470;" and insert -- I466; I470; --.

In Column 26, Line 35, delete "1595;" and insert -- I595; --.

In Column 26, Line 35, delete "1673;" and insert -- I673; --.

In Column 26, Line 36, delete "1872;" and insert -- I872; --.

In Column 26, Line 36, delete "1933;" and insert -- I933; --.

In Column 26, Line 37, delete "1958;" and insert -- I958; --.

In Column 26, Line 39, delete "11083; 11090." and insert -- I1083; I1090. --.

In Column 30, Line 30, delete "ClustalW," and insert -- Clustal W, --.

In Column 30, Line 34, delete "maq. sourceforge.net)." and insert -- maq.sourceforge.net). --.

In Column 36, Line 15, delete "(PfCsxl," and insert -- (PfCsx1, --.

In Column 37, Line 2, delete "0-hairpin." and insert -- β-hairpin. --.

In Column 48, Line 63, delete "1713," and insert -- I713, --.

In Column 48, Line 64, delete "1879," and insert -- I879, --.

In Column 48, Line 66, delete "11334," and insert -- I1334, --.

In Column 49, Line 1, delete "11558," and insert -- I1558, --.

In Column 53, Line 42, delete "matoside" and insert -- maltoside --.

CERTIFICATE OF CORRECTION (continued)
U.S. Pat. No. 11,898,142 B2

In Column 54, Line 13, delete "Dectection" and insert -- Detection --.

In Column 55, Line 30, delete "interrogater)." and insert -- interrogator). --.

In Column 59, Line 35, delete "3" and insert -- β --.

In Column 69, Line 40, delete "baumanii," and insert -- baumannii, --.

In Column 69, Line 45, delete "Anaplasma marginale" and insert -- Anaplasma marginale, --.

In Column 69, Line 46, delete "baumanii," and insert -- baumannii, --.

In Column 69, Line 55, delete "melintensis" and insert -- melitensis --.

In Column 69, Line 64, delete "jeikeum" and insert -- jeikeium --.

In Column 70, Line 7, delete "chafeensia" and insert -- chaffeensis --.

In Column 70, Line 20, delete "hemolytica," and insert -- haemolytica, --.

In Column 70, Line 26, delete "Mycoplasm" and insert -- Mycoplasma --.

In Column 70, Lines 39-40, delete "(formerly." and insert -- (formerly: --.

In Column 70, Line 44, delete "cholerasuis" and insert -- choleraesuis --.

In Column 70, Line 45, delete "marcesans" and insert -- marcescens --.

In Column 70, Lines 45-46, delete "liquifaciens)," and insert -- liquefaciens), --.

In Column 71, Line 6, delete "equismilis," and insert -- equisimilis, --.

In Column 71, Line 8, delete "moniliformi," and insert -- moniliformis, --.

In Column 71, Line 10, delete "petenue," and insert -- pertenue, --.

In Column 71, Line 14, delete "parahemolyticus," and insert -- parahaemolyticus, --.

In Column 71, Line 17, delete "metchnikovii," and insert -- metschnikovii, --.

In Column 71, Line 18, delete "furnisii)," and insert -- furnissii), --.

In Column 71, Line 26, delete "Coccidiodomycosis," and insert -- Coccidioidomycosis, --.

In Column 71, Line 27, delete "gatti," and insert -- gattii, --.

CERTIFICATE OF CORRECTION (continued)
U.S. Pat. No. 11,898,142 B2

In Column 71, Line 30, delete "Mucroymcosis," and insert -- Mucormycosis, --.

In Column 71, Line 53, delete "Euglenoza" and insert -- Euglenozoa --.

In Column 71, Lines 58-59, delete "Diplomonadid" and insert -- Diplomonadida --.

In Column 71, Line 62, delete "madrillaris," and insert -- mandrillaris, --.

In Column 72, Line 27, delete "mmarenavirus," and insert -- mammarenavirus, --.

In Column 72, Line 28, delete "paramyoxivirus," and insert -- paramyxovirus, --.

In Column 72, Line 30, delete "paramyoxviruses," and insert -- paramyxoviruses, --.

In Column 72, Line 31, delete "Islandsvirus," and insert -- Islands Virus, --.

In Column 72, Line 33, delete "Betacoronoavirus," and insert -- Betacoronavirus, --.

In Column 72, Line 37, delete "Bunyamwere" and insert -- Bunyamwera --.

In Column 72, Line 38, delete "Canaine" and insert -- Canine --.

In Column 72, Line 50, delete "paramyoxiviurs" and insert -- paramyxovirus --.

In Column 72, Line 55, delete "gential" and insert -- genital --.

In Column 72, Line 59, delete "paraechovirus," and insert -- parechovirus, --.

In Column 72, Line 61, delete "Japanses" and insert -- Japanese --.

In Column 73, Line 9, delete "Moijang" and insert -- Mojiang --.

In Column 73, Line 9, delete "Mokolo" and insert -- Mokola --.

In Column 73, Line 10, delete "leukoenchalitis" and insert -- leukoencephalitis --.

In Column 74, Line 49, delete "Malocoherpesviridae," and insert -- Malacoherpesviridae, --.

In Column 74, Line 54, delete "Maseilleviridae," and insert -- Marseilleviridae, --.

In Column 75, Line 16, delete "falciparum:" and insert -- falciparum --.

In Column 75, Line 30, delete "maj or" and insert -- major --.

In Column 76, Line 27, delete "atemisins" and insert -- artemisinin --.

CERTIFICATE OF CORRECTION (continued)
U.S. Pat. No. 11,898,142 B2

In Column 76, Line 47, delete "Na+/H$^+$" and insert -- Na$^+$/H$^+$ --.

In Column 76, Line 62, delete "(Pfinrp)," and insert -- (Pfmrp), --.

In Column 77, Line 26, delete "WHO/HTMGMP/" and insert -- WHO/HTM/GMP/ --.

In Column 77, Line 31, delete "511" and insert -- 51I --.

In Column 77, Line 53, delete "(PJCRT)," and insert -- (PfCRT), --.

In Column 78, Line 58, delete "sporpogonic" and insert -- sporogonic --.

In Column 79, Line 52, delete "3" and insert -- β --.

In Column 87, Line 52, delete "6,465,177B 1)." and insert -- 6,465,177 B1). --.

In Column 90, Line 57, delete "12p13.32-p3.2," and insert -- 12p13.32-p13.2, --.

In Column 95, Line 4, delete "(FIG." and insert -- (FIGS. --.

In Column 95, Line 14, delete "(FIG." and insert -- (FIGS. --.

In Column 95, Line 67, delete "71" and insert -- 7I --.

In Column 96, Line 12, delete "(FIG." and insert -- (FIGS. --.

In Column 96, Line 17, delete "(FIG." and insert -- (FIGS. --.

In Column 96, Line 27, delete "(FIG." and insert -- (FIGS. --.

In Column 96, Line 46, delete "(FIG." and insert -- (FIGS. --.

In Column 97, Line 8, delete "(FIG." and insert -- (FIGS. --.

In Column 97, Line 14, delete "FIG." and insert -- FIGS. --.

In Column 97, Line 14, delete "FIG." and insert -- FIGS. --.

In Column 97, Line 34, delete "(FIG." and insert -- (FIGS. --.

In Column 97, Line 45, delete "(FIG." and insert -- (FIGS. --.

In Column 97, Line 52, delete "(FIG." and insert -- (FIGS. --.

In Column 97, Line 67, delete "jaM," and insert -- μM, --.

CERTIFICATE OF CORRECTION (continued)
U.S. Pat. No. 11,898,142 B2

In Column 99, Line 17, delete "120 nM,60" and insert -- 120 nM, 60 --.

In Column 102, Line 49, delete "Weblogo3." and insert -- Weblogo 3. --.

In the Claims

In Column 107, Line 56, in Claim 7, delete "{N/H/K]" and insert -- {N/H/K} --.

In Column 107, Line 65, in Claim 9, delete "Corynebacter," and insert -- Corynebacterium, --.

In Column 108, Line 60, in Claim 11, delete "optionally wherein the ribozyme converts a substrate" and insert -- wherein the ribozyme optionally converts a substrate --.

In Column 110, Line 28, in Claim 25, delete "Malocoherpesviridae," and insert -- Corynebacterium, --.

In Column 110, Line 33, in Claim 25, delete "Maseilleviridae," and insert -- Marseilleviridae, --.

In Column 110, Line 49, in Claim 26, delete "Boma" and insert -- Borna --.

In Column 110, Line 59, in Claim 27, delete "Aerococcus species" and insert -- Aerococcus species, --.

In Column 110, Line 65, in Claim 27, delete "Corynbacterium" and insert -- Corynebacterium --.

In Column 111, Line 1, in Claim 27, delete "Ehlichia" and insert -- Ehrlichia --.

In Column 111, Line 10, in Claim 27, delete "Morganell" and insert -- Morganella --.

In Column 111, Line 11, in Claim 27, delete "Mycoplasm" and insert -- Mycoplasma --.

In Column 111, Line 17, in Claim 27, delete "Propionibacteriums" and insert -- Propionibacterium --.

In Column 111, Line 28, in Claim 28, delete "Coccidiodomycosis," and insert -- Coccidioidomycosis, --.

In Column 111, Line 29, in Claim 28, delete "gatti," and insert -- gattii, --.

In Column 111, Line 32, in Claim 28, delete "Mucroymcosis," and insert -- Mucormycosis, --.

In Column 111, Line 50, in Claim 30, delete "canthamoeba" and insert -- acanthamoeba --.

In Column 111, Line 50, in Claim 30, delete "madrillaris," and insert -- mandrillaris, --.